US008748699B2

(12) United States Patent
Reuzeau et al.

(10) Patent No.: US 8,748,699 B2
(45) Date of Patent: Jun. 10, 2014

(54) PLANTS HAVING ENHANCED YIELD-RELATED TRAITS AND A METHOD FOR MAKING THE SAME BY OVEREXPRESSING A POLYNUCLEOTIDE ENCODING A TFL1-LIKE PROTEIN

(75) Inventors: Christophe Reuzeau, Tocan Saint Apre (FR); Yves Hatzfeld, Lille (FR); Valerie Frankard, Waterloo (BE); Ana Isabel Sanz Molinero, Gentbrugge (BE)

(73) Assignee: BASF Plant Science GmbH, Ludwigshafen (DE)

( * ) Notice: Subject to any disclaimer, the term of this patent is extended or adjusted under 35 U.S.C. 154(b) by 362 days.

(21) Appl. No.: 13/002,436

(22) PCT Filed: Jul. 2, 2009

(86) PCT No.: PCT/EP2009/058310
§ 371 (c)(1),
(2), (4) Date: Jan. 3, 2011

(87) PCT Pub. No.: WO2010/000794
PCT Pub. Date: Jan. 7, 2010

(65) Prior Publication Data
US 2011/0107465 A1      May 5, 2011

Related U.S. Application Data

(60) Provisional application No. 61/078,499, filed on Jul. 7, 2008, provisional application No. 61/079,158, filed on Jul. 9, 2008, provisional application No. 61/079,817, filed on Jul. 11, 2008, provisional application No. 61/079,868, filed on Jul. 11, 2008, provisional application No. 61/081,923, filed on Jul. 18, 2008.

(30) Foreign Application Priority Data

| Jul. 4, 2008 | (EP) | .................................... 08159749 |
| Jul. 8, 2008 | (EP) | .................................... 08159946 |
| Jul. 10, 2008 | (EP) | .................................... 08160149 |
| Jul. 10, 2008 | (EP) | .................................... 08160152 |
| Jul. 17, 2008 | (EP) | .................................... 08160632 |

(51) Int. Cl.
*A01H 1/00*   (2006.01)
*C12N 15/87*  (2006.01)
*C12N 15/82*  (2006.01)
*A01H 5/00*   (2006.01)
*C12N 5/04*   (2006.01)
*C12N 5/10*   (2006.01)

(52) U.S. Cl.
USPC ............ 800/290; 800/298; 435/468; 435/419

(58) Field of Classification Search
USPC ....................................................... 800/289
See application file for complete search history.

(56) References Cited

U.S. PATENT DOCUMENTS

| 6,025,543 | A   | 2/2000  | Yanofsky |
| 6,573,430 | B1  | 6/2003  | Bradley et al. |
| 6,936,708 | B1  | 8/2005  | Winicov |
| 7,214,786 | B2  | 5/2007  | Kovalic et al. |
| 2006/0070141 | A1 | 3/2006 | Nielsen et al. |
| 2006/0272057 | A1* | 11/2006 | Danilevskaya et al. ........ 800/287 |
| 2006/0288454 | A1* | 12/2006 | Sanz Molinero ............. 800/287 |

FOREIGN PATENT DOCUMENTS

| EP | 1033405 A2 | 9/2000 |
| WO | WO-99/53016 A2 | 10/1999 |
| WO | WO-2006/127310 A2 | 11/2006 |

OTHER PUBLICATIONS

Kikuchi et al., Molecular and Functional Characterization of PEBP Genes in Barley Reveal the Diversification of Their Roles in Flowering, 149 Plant Physiology, 1341-1353 (2009).*
Terence A. Brown, Genomes Chapter 7 § 7.2.1 (Oxford: Wiley-Liss) (2nd ed. 2002).*
Aasland, R., et al., "The PHD finger: Implications for chromatin-mediated transcriptional regulation," Trends Biochem. Sci., 1995, vol. 20, pp. 56-59.
Ahn, J. H., et al., "A divergent external loop confers antagonistic activity on floral regulators FT and TFL1," EMBO Journal, 2006, vol. 25, pp. 605-614.
Argiriou, A., et al., "Characterization and expression analysis of Terminal Flower1 homologs from cultivated alloteraploid cotton (*Gossypium hirsutum*) and its diploid progenitors," Journal of Plant Physiology, 2008, vol. 165, pp. 1636-1646.
Bastola, D. R., et al., "Alfin1, a novel zinc-finger protein in alfalfa roots that binds to promoter elements in the salt-inducible *MsPRP2* gene," Plant Molecular Biology, 1998, vol. 38, pp. 1123-1135.
Baurle, I., et al., "The Timing of Developmental Transitions in Plants," Cell, 2006, vol. 125, pp. 655-664.

(Continued)

*Primary Examiner* — Cynthia Collins
*Assistant Examiner* — Rebecca Coobs
(74) *Attorney, Agent, or Firm* — Drinker Biddle & Reath LLP

(57) ABSTRACT

The present invention relates generally to the field of molecular biology and concerns a method for enhancing various yield-related traits by modulating expression in a plant of a nucleic acid encoding a TFL1 Like (Terminal Flower Like 1) polypeptide. The present invention also concerns plants having modulated expression of a nucleic acid encoding a TFL1 Like polypeptide, which plants have enhanced yield-related traits relative to corresponding wild type plants or other control plants. The invention also provided hitherto unknown TFL1-Like encoding nucleic acids, and constructs comprising the same, useful in performing the methods of the invention.

16 Claims, 57 Drawing Sheets

(56) References Cited

OTHER PUBLICATIONS

Botstein, D., et al., "Construction of a Genetic Linkage Map in Man Using Restriction Fragment Length Polymorphisms," Am. J. Hum. Genet., 1980, vol. 32, pp. 314-331.
Carmona, M. J., et al., "The *FT/TFL1* gene family in grapevine," Plant Mol. Biol., 2007, vol. 63, pp. 637-650.
Chardon, F., et al., "Phylogenomic Analysis of the PEBP Gene Family in Cereals," J. Mol. Evol., 2005, vol. 61, pp. 579-590.
Danilevskaya, O. N., et al., "A Genomic and Expression Compendium of the Expanded *PEBP* Gene Family from Maize," Plant Physiology, 2008, vol. 146, pp. 250-264.
Frink, C. R., et al., "Nitrogen fertilizer: Retrospect and prospect," Proc. Natl. Acad. Sci. USA, 1999, vol. 96, pp. 1175-1180.
Gasteiger, E., et al., "ExPASy: the proteomics server for in-depth protein knowledge and analysis," Nucleic Acids Research, 2003, vol. 31, No. 13, pp. 3784-3788.
Gontero, B., et al., "A functional five-enzyme complex of chloroplasts involved in the Calvin cycle," Eur. J. Biochem., 1988, vol. 173, pp. 437-443.
Gutterson, N., et al., "Regulation of disease resistance pathways by AP2/ERF transcription factors," Current Opinion in Plant Biology, 2004, vol. 7, pp. 465-471.
Hishiya, A., et al., "A novel ubiquitin-binding protein ZNF216 functioning in muscle atrophy," EMBO Journal, 2006, vol. 25, pp. 554-564.
Holmes, M. A., et al., "Structure of ribose 5-phosphate isomerase from *Plasmodium falciparum*," Acta Cryst., 2006, vol. F62, pp. 427-431.
Howles, P. A., et al., "A mutation in an *Arabidopsis* ribose 5-phosphate isomerase reduces cellulose synthesis and is rescued by exogenous uridine," The Plant Journal, 2006, vol. 48, pp. 606-618.
Igasaki, T., et al., "The *Flowering Locus* η *Terminal Flower 1* Family in Lombardy Poplar," Plant Cell Physiol., 2008, vol. 49, pp. 291-300.
Jung, C., et al., "$_D$-Ribose-5-Phosphate Isomerase from Spinach: Heterologous Overexpression, Purification, Characterization, and Site-Directed Mutagenesis of the Recombinant Enzyme," Archives of Biochemistry and Biophysics, 2000, vol. 373, No. 2, pp. 409-417.
Kanneganti, V., et al., "Overexpression of *OsiSAP8*, a member of stress associated protein (SAP) gene family of rice confers tolerance to salt, drought and cold stress in transgenic tobacco and rice," Plant Mol. Biol., 2008, vol. 66, pp. 445-462.
Kardailsky, I., et al., "Activation Tagging of the Floral Inducer *FT*," Science, 1999, vol. 286, pp. 1962-1965.
Kobayashi, Y., et al., "A Pair of Related Genes with Antagonistic Roles in Mediating Flowering Signals," Science, 1999, vol. 286, pp. 1960-1962.
Lander, E. S., et al., "Mapmaker: An Interactive Computer Package for Constructing Primary Genetic Linkage Maps of Experimental and Natural Populations," Genomics, 1987, vol. 1, pp. 174-181.
Letunic, I., et al., "Recent improvements to the SMART domain-based sequence annotation resource," Nucleic Acids Research, 2002, vol. 30, No. 1, pp. 242-244.
Linnen, J. M., et al., "Two related localized mRNAs from *Xenopus laevis* encode ubiquitin-like fusion proteins," Gene, 1993, vol. 128, pp. 181-188.
Mimida, N., et al., "Functional divergence of the *TFL1*-like gene family in *Arabidopsis* revealed by characterization of a novel homologue," Genes to Cells, 2001, vol. 6, pp. 327-336.
Nakagawa, M., et al., "Overexpression of *RCN1* and *RCN2*, rice *Terminal Flower 1\Centroradialis* homologs, confers delay of phase transition and altered panicle morphology in rice," The Plant Journal, 2002, vol. 29, pp. 743-750.
Opipari, A. W., et al., "The A20 cDNA Induced by Tumor Necrosis Factor ∝ Encodes a Novel Type of Zinc Finger Protein," The Journal of Biological Chemistry, 1990, vol. 265, No. 25, pp. 14705-14708.
Rabbani, M. A., et al., "Monitoring Expression Profiles of Rice Genes under Cold, Drought, and High-Salinity Stresses and Abscisic Acid Application Using cDNA Microarray and RNA Gel-Blot Analyses," Plant Physiology, 2003, vol. 133, pp. 1755-1767.
Ratcliffe, O. J., et al., "A common mechanism controls the life cycle and architecture of plants," Development, 1998, vol. 125, pp. 1609-1615.
Riechmann, J. L., et al., "*Arabidopsis* Transcription Factors: Genome-Wide Comparative Analysis Among Eukaryotes," Science, 2000, vol. 290, pp. 2105-2110.
Schultz, J., et al., "SMART, a simple modular architecture research tool: Identification of signaling domains," Proc. Natl. Acad. Sci. USA, 1998, vol. 95, pp. 5857-5864.
Storozhenko, S., et al., "*Arabidopsis* coactivator ALY-like proteins, DIP1 and DIP2, interact physically with the DNA-binding domain of the Zn-finger poly(ADP-ribose) polymerase," Journal of Experimental Biology, 2001, vol. 52, No. 359, pp. 1375-1380.
Straesser, K., et al., "Yra1p, a conserved nuclear RNA-binding protein, interacts directly with Mex67p and is required for mRNA export," EMBO Journal, 2000, vol. 19, No. 3, pp. 410-420.
Uhrig, J. F., et al., "Relocalization of Nuclear ALY Proteins to the Cytoplasm by the Tomato Bushy Stunt Virus P19 Pathogenicity Protein," Plant Physiology, 2004, vol. 135, pp. 2411-2423.
Vij, S., et al., "A20/AN1 zinc-finger domain-containing proteins in plants and animals represent common elements in stress response," Funct. Integr. Genomics, 2008, vol. 8, pp. 301-307.
Vinocur, B., et al., "Recent advances in engineering plant tolerance to abiotic stress: achievements and limitations," Current Opinion in Biotechnology, 2005, vol. 16, pp. 123-132.
Wang, W., et al., "Plant responses to drought, salinity, and extreme temperatures: towards genetic engineering for stress tolerance," Planta, 2003, vol. 218, pp. 1-14.
Winicov, I., "Alfin1 transcription factor overexpression enhances plant root growth under normal and saline conditions and improves salt tolerance in alfalfa," Planta, 2000, vol. 210, pp. 416-422.
Winicov, I., et al., "Transgenic Overexpression of the Transcription Factor *Alfin 1* Enhances Expression of the Endogenous *MsPRP2* Gene in Alfalfa and Improves Salinity Tolerance of the Plants," Plant Physiology, 1999, vol. 120, pp. 473-480.

\* cited by examiner

```
                              1                                                50
Arath_TFL1_like_1      (1)   -----------------MARISSDPLMVGRVIGDVVDNCLQAVKMTVTY
Poptr_TFL1-like_2      (1)   -----------------MANLSDPLVVGRVIGDVIDYFTPNVKMTVTY
Poptr_TFL1-like_3      (1)   -----------------MAKMSEPLVVGRVIGDVIDHFTANVKMTVTY
Solly_TFL1_like_1      (1)   -----------------MASKMCEPLVIGRVIGEVVDYFCPSVKMSVVY
Glyma_TFL1_like_1      (1)   ------------------------------------------MNVTY
Poptr_TFL1_like_1      (1)   -----------------MSRAMEPLTVGRVVGDVVDIFTPSVRMTVTY
Zeama_TFL1_like_3      (1)   -----------------MSRALEPLVVGKVIGEVIDNFNPTVKMTVTY
Orysa_TFL1_like_2      (1)   -----------------MSRSVEPLVVGRVIGEVIDSFNPCTKMIVTY
Orysa_TFL1_like_1      (1)   -----------------MSRSVEPLVVGHVIGEVLDTFNPCMKMIVTY
Triae_TFL1_like_1      (1)   -----------------MSRSVEPLIVGRVIGEVLDTFNPCVKMVTTY
Zeama_TFL1_like_1      (1)   -----------------MSRSVEPLIVGRVIGEVLDSFNPCVKMIVTY
Zeama_TFL1_like_2      (1)   -----------------MSRSVEPLIVGRVIGEVLDSFNPCVKMIVTY
        Consensus      (1)                    MSRSVEPLVVGRVIGEVID FNP VKMTVTY 51                                               100
Arath_TFL1_like_1     (33)   NSD-KQVYNGHELFPSVVTYKPKVEVHGGDMRSFFTLVMTDPDVPGPSDP
Poptr_TFL1-like_2     (32)   NSN-KQVYNGHELFPSAVTHKPKVEVHGGDMRSFFTLIMTDPDVPGPSDP
Poptr_TFL1-like_3     (32)   QSNRKQVFNGHELFPSAVTHKPKVEVHGGDMRSFFTLVMTDPDVPGPSDP
Solly_TFL1_like_1     (33)   NNN-KHVYNGHEFFPSSVTSKPRVEVHGGDLRSFFTLIMIDPDVPGPSDP
Glyma_TFL1_like_1      (6)   S-T-KQVANGHELMPSTIMAKPRVEIGGDDMKTAYTSVMTDPDAPSPSDP
Poptr_TFL1_like_1     (32)   NSN-KQVANGYEFMPSVIAYKPRVEIGGEDMRTAYTLIMTDPDAPSPSDP
Zeama_TFL1_like_3     (32)   GSN-KQVFNGHEFFPSAVLSKPRVEVQGDDMRSFFTLVMTDPDVPGPSDP
Orysa_TFL1_like_2     (32)   NSN-KLVFNGHEFYPSAVVSKPRVEVQGGDMRSFFTLVMTDPDVPGPSDP
Orysa_TFL1_like_1     (32)   NSN-KLVFNGHELYPSAVVSKPRVEVQGGDLRSFFTLVMTDPDVPGPSDP
Triae_TFL1_like_1     (32)   NSN-KLVFNGHELYPSAVVSKPRVEVQGGDLRSLFTLVMTDPDVPGPSDP
Zeama_TFL1_like_1     (32)   NSN-KLVFNGHEIYPSAVVSKPRVEVQGGDLRSFFTLVMTDPDVPGPSDP
Zeama_TFL1_like_2     (51)   NSN-KLVFNGHEIYPSAIVSKPRVEVQGGDLRSFFTLVMTDPDVPGPSDP
        Consensus    (51)   NSN KQVFNGHELFPSAVVSKPRVEVQGGDMRSFFTLVMTDPDVPGPSDP 101                                               150
Arath_TFL1_like_1     (82)   YLREHLHWIVTDIPGTTDVSFGKEIIGYEMPRPNIGIHRFVYLLFKQTRR
Poptr_TFL1-like_2     (81)   YLREHLHWIVTDIPGTTDATFGREVVNYEMPRPNIGIHRFVYLLFRQKGR
Poptr_TFL1-like_3     (82)   YLREHLHWIVTDIPGTTDATFGREVMNYEMPRPNIGIHRFVFLLFKQKGR
Solly_TFL1_like_1     (82)   YLREHLHWIVTDIPGTTDCSFGREVVGYEMPRPNIGIHRFVFLLFKQKKR
Glyma_TFL1_like_1     (54)   CLREHLHWMVTDIPGTTDVSFGKEIVGYESPKPVIGIHRYVFILFKQRGR
Poptr_TFL1_like_1     (81)   YLREHLHWMVTDIPGTTDVSFGREIVSYETPKPVVGIHRYVFILFKQRGR
Zeama_TFL1_like_3     (81)   YLREHIHWIVTDIPGTTDASFGRELVMYESPKPYIGIHRFVFVLFKQSSR
Orysa_TFL1_like_2     (81)   YLREHLHWIVTDIPGTTDASFGREIISYESPKPSIGIHRFVFVLFKQKRR
Orysa_TFL1_like_1     (81)   YLREHLHWIVTDIPGTTDASFGREVISYESPKPNIGIHRFIFVLFKQKRR
Triae_TFL1_like_1     (81)   YLREHLHWIVTDIPGTTDASFGREVISYESPKPNIGIHRFIFVLFKQKRR
Zeama_TFL1_like_1     (81)   YLREHLHWIVTDIPGTTDASFGRQIISYESPRPSIGIHRFIFVLFKQQGR
Zeama_TFL1_like_2    (100)   YLREHLHWIVTDIPGTTDASFGREVISYESPRPNIGIHRFIFVLFKQKGR
        Consensus   (101)   YLREHLHWIVTDIPGTTDASFGREVISYESPKPNIGIHRFVFVLFKQKGR 151                                               198
Arath_TFL1_like_1    (132)   GSVVSVPSY---RDQFNTREFAHENDLGLPVAAVFFNCQRETAARRR-
Poptr_TFL1-like_2    (131)   -QTVSTPSS---RDKFNTRKFAEENELDLPVAAVFFNAQRETAARRR-
Poptr_TFL1-like_3    (132)   -QTVTTPAS---RDKFNTRKFAEENELGLPVAAVFFNAQRETAARKR-
Solly_TFL1_like_1    (132)   QTISSAPVS---RDQFSSRKFSEENELGSPVAAVFFNCQRETAARRR-
Glyma_TFL1_like_1    (104)   QTVR-PPSS---RDHFNTRRFSEENGLGLPVAAVYFNAQRETAARRR-
Poptr_TFL1_like_1    (131)   QTVRAPPAS---RDCFNTRMFAGENGLGLPVAAVYFNAQRETAARRR-
Zeama_TFL1_like_3    (131)   -QSARPPSSGGGRDYFNTRRFAADNNLGLPVAAVFFNAQRETAARRR-
Orysa_TFL1_like_2    (131)   -QAVVVPSS---RDHFNTRQFAEENELGLPVAAVYFNAQRETAARRR-
Orysa_TFL1_like_1    (131)   -QTVIVPSF---RDHFNTRRFAEENDLGLPVAAVYFNAQRETAARRR-
Triae_TFL1_like_1    (131)   -QTVTVPSF---RDHFNTRQFAAENDLGLPVAAVYFNCQRETAARRR-
Zeama_TFL1_like_1    (131)   -QNVTVPSF---RDHFNTRQFAEENDLGLPVAAVYFNAQRETAARRR-
Zeama_TFL1_like_2    (150)   -QTVTVPSF---RDHFNTRQFAEENDLGLPVAAVYFNAQRETAARRR-
        Consensus   (151)    QTVTVPSS    RDHFNTRKFAEENDLGLPVAAVYFNAQRETAARRR
```

FIGURE 1

```
                                         1                                                50
A.thaliana_AT1G71100       (1) ------------------------------------MGSAFDPLVTATE
A.thaliana_AT3G04790       (1) --------------MASLSFVSSSH------------LTLRTPSIALRST
G.arboreum_BG444582        (1) --------------MASLSFLHLSS---------ATRFTPRATPLNHRAR
G.arboreum_TA5822          (1) --------------MASLSFLHLSS---------ATRFTPRATPLNHRAR
G.hirsutum_TA26611         (1) --------------MASLSFLHLSS---------ATRFTPRATPINHRAR
G.hirsutum_TA28664         (1) ----------MASLSLNLSSLHHTS---------INPLILRCTPLNLRTP
G.max_TA40887              (1) --------------MASLSLSSPPS------LSSAHHNA--STRLILRTP
P.trichocarpa_70.79        (1) --------------MASLSLLPSPSSSSSSSLSSLHHTTPSSSRLTLCTP
P.trichocarpa_XIII.387     (1) --------------MASLSFLSPPSSSS---LSSLHNTTPSSSRLFLRTP
S.lycopersicum_TA38172     (1) --------------MASLSLISPHSPSSSSSSTLRHSSIIGTRLPSIFLR
O.sativa_Os07g0176900      (1) -----------------------------MAAATVSVRFHPAASAAR
S.officinarum_TA43377      (1) -----------------------------MAAATAISVRLHPTAASHV
Z.mays_TA182909            (1) -----------------------------MAATAISVRLHPTAARHV
C.reinhardtii_55838        (1) -----------------------------MMLKASPAARAAA
P.patens_133835            (1) --------------------------------------------------
P.patens_221767            (1) MASSAMLASQAPTGASGVAVVSVPRSSVSGSSSSTTQLSVKSFGASSTLL
O.tauri_25759              (1) --------------------------------------------------
O.sativa_Os04g0306400      (1) ---------------------------------MGSFASPLDAAPA
S.officinarum_TA35800      (1) ---------------------------------MGSAAAS------
Z.mays_TA181232            (1) ---------------------------------MGSAAAS------
S.officinarum_TA48272      (1) ---------------------------------MGSAAAAS-----
Z.mays_DR791617            (1) ---------------------------------MGSAAAS------
T.aestivum_CK211981        (1) ---------------------------------MDEAASP------
A.thaliana_AT2G01290       (1) ---------------------------------MALAYDPLFITSD
G.hirsutum_TA22941         (1) ---------------------------------MAVAWSEKASSME
G.hirsutum_TA36027         (1) ---------------------------------MAIAWSEKASFME
G.hirsutum_TA25911         (1) ---------------------------------MAIAWSETAASME
P.trichocarpa_VIII.1184    (1) ---------------------------------MAIPCPPFIGSEK
P.trichocarpa_X.1083       (1) ---------------------------------MAIPCPSIFGSEM
G.max_TA43617              (1) ---------------------------------MAIPYPHFIATEK
P.trichocarpa_I.1144       (1) ---------------------------------MAIPYHHFNLVTS
S.lycopersicum_TA43275     (1) ---------------------------------MAVAYPQFFGTKK
               Consensus   (1)                                  MAI
```

FIGURE 4

```
                              51                                               100
        A.thaliana_AT1G71100  (14) DL--------------AAVNSAPPLS--------NLTQEELKKIAAYKA
        A.thaliana_AT3G04790  (25) GSSP---------R-TSVSFSVKAQSVAL--------SQDDLKKLAAEKA
          G.arboreum_BG444582 (28) TQ--------------KSFSIRSQSAPV-------LSQDELKKLAADKA
           G.arboreum_TA5822  (28) TQ--------------KSFSIRSQSAPV-------LSQDELKKLAADKA
           G.hirsutum_TA26611 (28) TQ--------------KSFSIRSQSAPV-------LSQDELKKLAADKA
           G.hirsutum_TA28664 (32) SQ--------------KPFSIRSQAAPV-------LSQDDLKKLAADKA
                G.max_TA40887 (29) NS-L---------KLRTPPHSLPAIRAIT-------LTQDDLKRLAADKA
           P.trichocarpa_70.79 (37) SLNV---------RTRTKISSIKAQSAPV-------LTQDDLKKLAADKA
         P.trichocarpa_XIII.387 (34) SLNL---------RAPTKIFSLKAQSAPV-------LTQDELKKIAADKA
        S.lycopersicum_TA38172 (37) NPTI---------RIRSTTPSIKAFSAPV----PSPLTQDELKKLAADKA
        O.sativa_Os07g0176900 (19) CGGGSR-------RSRRLSGVIRAQSAPASAAA-AALTQDDLKRLAAVRA
        S.officinarum_TA43377 (20) ASSA---------RRRARLGSVRAQSAP--AAA-AALTQDDLKRLAAVRA
             Z.mays_TA182909  (19) AS-----------ARRARLGAVRAQSAPA-AAA-AALTQDDLKRLAAVRA
          C.reinhardtii_55838 (14) RP--------------AARNVRMMAAPVS----TQLSQDELKKQAAWKA
               P.patens_133835 (1) ----------------MNAIVPDGFASESDAG-TKLTQDELKKIAAEKA
               P.patens_221767 (51) CGGEVVQKQAGFGSVPKKSNAMTFAPRAQSQAT-QALTQDELKKIAAEKA
                 O.tauri_25759 (1) --------------------------------MTQDELKKLVGYKS
        O.sativa_Os04g0306400 (14) PPTAKP----------SPPPAPAPANGL-------VTQEELKRVAAHRA
        S.officinarum_TA35800 (8) ---------------------PPPSGK-------LTQDELKRVAAHRA
             Z.mays_TA181232  (8) ---------------------PPPSGK-------LTQEELKRVAAHRA
        S.officinarum_TA48272 (9) ---------------------PPPPSGN------LTQDELKRVAAHRA
             Z.mays_DR791617  (8) ---------------------PQPSGN-------LTQDELKRVAAHRA
          T.aestivum_CK211981 (8) ---------------------RGACKG-------GTTKTSRAFPGHGP
        A.thaliana_AT2G01290  (14) KS--------------LSAFDVASSPPQP----MNLTQDELKRIAAYKA
           G.hirsutum_TA22941 (14) AL--------------SLSPPMSPP--------VILTQDELKKIAAYKA
           G.hirsutum_TA36027 (14) VL--------------SRPPSLSPP--------VILTQDELKKIAAYKA
           G.hirsutum_TA25911 (14) AL--------------SLSPPMSPP--------VILTQDELKKIAAYKA
       P.trichocarpa_VIII.1184 (14) LS--------------IESGAMSPSSPSP----LILTQDELKKIAAYKA
         P.trichocarpa_X.1083 (14) VP--------------IESGAMSPP-PSP----LILTQDELKKIAAYKA
                G.max_TA43617 (14) AA--------------MDAGLLHPSSPS-----VILTQDDLKKIAAYKA
         P.trichocarpa_I.1144 (14) EK--------------PDMEMLFPSP-------VVLTQDELKKIAAYKA
        S.lycopersicum_TA43275 (14) VD--------------TSLMVSSSSSVSP----VILSQDELKKIAAYKA
                    Consensus (51)                 I  A   SA        LTQDELKKIAAYKA
```

FIGURE 4 (continued)

```
                                        101                                          150
      A.thaliana_AT1G71100         (41) VEF-VESGMVIGLGTGSTAKHAVARISELLR-EGKLKDIIGIPTSTTTHE
      A.thaliana_AT3G04790         (57) VEA-IKPGMVLGLGTGSTAAFAVDQIGKLLS-SGELYDIVGIPTSKRTEE
       G.arboreum_BG444582         (56) VES-VKSGMVLGLGTGSTAAFVVDKLGQLLS-TGQLSNIVGIPTSKRTQE
         G.arboreum_TA5822         (56) VES-VKSGMVLGLGTGSTAAFVVDKLGQLLS-TGQLSNIVGIPTSKRTQE
        G.hirsutum_TA26611         (56) VES-VKSGMVLGLGTGSTAAFVVDKLGQLLS-TGQLSNIVGIPTSKRTQE
        G.hirsutum_TA28664         (60) VES-VKSGMILGLGTGSTAAFVVDKIGQLLS-TGQLSNIVGIPTSKRTQE
            G.max_TA40887          (62) VES-VKSGMVLGLGTGSTAAFVVAKLGALLA-SGQLSDIVGVPTSKRTEE
       P.trichocarpa_70.79         (71) VEY-VKSGMVLGLGTGSTAAFVVAKLGELLK-TGELKDIIGVPTSKRTEE
     P.trichocarpa_XIII.387        (68) VEY-VKSGMVLGLGTGSTAAFVVAKLGELLK-TGELTNIIGVPTSKRTEE
      S.lycopersicum_TA38172       (74) VEY-VKSGMVLGLGTGSTAAFVVAKLGELLS-SGQLTNIVGVPTSKRTEE
     O.sativa_Os07g0176900         (61) VEQ-VESGMVLGLGTGSTAAFAVAEIGALLA-SGKLSGIVGVPTSKRTFE
      S.officinarum_TA43377        (58) VEQ-VQSGMVLGLGTGSTAAFAVAEIGALLA-AGKLEKIVGVPTSKRTFE
            Z.mays_TA182909        (56) VEQ-VKSGMVLGLGTGSTAAFAVAEIGALLA-AGKLEKIVGVPTSKRTFE
        C.reinhardtii_55838        (45) VEY-VKSGMVVGLGTGSTAAFVVDRIGQLLK-EGKLQNIVGVPTSIRTYE
           P.patens_133835         (33) VEY-VKSGMVLGLGTGSTAAFVAVAKIGELLK-EGKLTDIVGVPTSKRTAE
           P.patens_221767        (100) VEY-VKSGMVLGLGTGSTAAFVAVAKIGELLK-EGKLTDIVGVPTSKRTAE
              O.tauri_25759        (15) VDDHVESGMVVGLGTGSTAYFAVERVGQKLA-SGELKNVICIPTSERTRE
     O.sativa_Os04g0306400         (46) VEM-VEPGMTLGLGTGSTAAHALDRLGDLLR-SGELAAVAGVPTSLKTEA
      S.officinarum_TA35800        (28) VEF-VEPGMTLGLGTGSTAAHALDRLGDLLR-AGALPGVAGVPTSLKTEA
            Z.mays_TA181232        (28) VEF-VEPGMTLGLGTGSTAAHALDRLGDLLR-AGALPGVAGVPTSLKTEA
      S.officinarum_TA48272        (30) VEF-VEPGMTLGLGTGSTAAHALDRLGDLIR-AGALPGVAGVPTSLKTEA
            Z.mays_DR791617        (28) VEF-VESGMTLGLGTGSTAAHALDRLGDLLR-AGALPGVAGVPTSLKTEA
         T.aestivum_CK211981       (28) IDM-WESGITLGLGTGSRPRNAFDPLRAPPSNRARCARSPGCPPPSKTRP
      A.thaliana_AT2G01290         (45) VEF-VESGMVLGLGTGSTAKHAVDRIGELLR-QGKLENIVGIPTSKKTQE
        G.hirsutum_TA22941         (41) VEF-VESGMVLGLGTGSTAKHAVDRIGELLR-QGKLTNIIGIPTSKKTQE
        G.hirsutum_TA36027         (41) VEF-VESGMVLGLGTGSTAKHAVDRIGELLR-LGKLKNIVGIPTSKKTQE
        G.hirsutum_TA25911         (41) VEF-VESGMVLGLGTGSTAKHAVDRIGKLLR-QGKLSNIVGIPTSKKTQE
     P.trichocarpa_VIII.1184       (45) VEF-VQSGMVLGLGTGSTAKHAVDRIADLLH-QGKLKNIIGIPTSTKTHQ
       P.trichocarpa_X.1083        (44) VEF-VQSGMVLGLGTGSTAKHAVDRIADLLH-QGKLKNIIGIPTSKKTHQ
            G.max_TA43617          (44) VEY-VESGMILGLGTGSTAKHAVDRIGELLR-QGKLKDIVGIPTSTKTHE
      P.trichocarpa_I.1144         (42) VEM-VESGMVVGLGTGSTAKHAVDRIGELLH-QGKLKNIIGIPTSTKTHE
      S.lycopersicum_TA43275       (45) VEF-VESGMVVGLGTGSTAKHAVDKIAELLH-SGKLKNIVGIPTSKITHE
                   Consensus      (101) VEF VESGMVLGLGTGSTAAFAVDRIGELLR  GKL N1VG1PTSKRT E
```

FIGURE 4 (continued)

```
                                         151                                          200
      A.thaliana_AT1G71100         (89) QAVSLGIPLSDLDSHPV-------VDLSIDGADEVDPALNLVKGRGGSLL
      A.thaliana_AT3G04790        (105) QARSLGIPLVGLDTHPR-------IDLAIDGADEVDPNLDLVKGRGGALL
       G.arboreum_BG444582        (104) QAASLNIPLSTLDLHPH-------IDLAIDGADEVDPNLDLVKGRGGALL
         G.arboreum_TA5822        (104) QAASLNIPLSTLDLHPH-------IDLAIDGADEVDPNLDLVKGRGGALL
        G.hirsutum_TA26611        (104) QAASLNIPLSTLDLHPH-------IDLAIDGADEVDPNLDLVKGRGGALL
        G.hirsutum_TA28664        (108) QAASLNIPLSTLDLHPR-------IDLAIDGADEVDPNLDLVKGRGGALL
            G.max_TA40887         (110) QARSLGIPLSVLDDNPR-------LDLAIDGADEVDPDLNLVKGRGGALL
      P.trichocarpa_70.79         (119) QARSLNIPLSVLDDHPH-------IDLAIDGADEVDPLLNLVKGRGGALL
    P.trichocarpa_XIII.387        (116) QARSLNIPLSTLDDHPH-------IDLAIDGADEVDPLLNLVKGRGGALL
    S.lycopersicum_TA38172        (122) QALSLNIPLSTLDDHPH-------IDLAIDGADEVDPNLDLVKGRGGALL
      O.sativa_Os07g0176900       (109) QAQSLGIPLSTLDDHPR-------IDLAIDGADEVDPDLNLVKGRGGALL
     S.officinarum_TA43377        (106) QAQSLGIPLSTLDDHPS-------IDLAIDGADEVDPDLNLVKGRGGALL
          Z.mays_TA182909         (104) QAQSLGIPLSTLDDNPL-------IDLAIDGADEVDPDLNLVKGRGGALL
       C.reinhardtii_55838         (93) QALSLGIPLATLDEQPK-------LDVAIDGADEVDPNLDVVKGRGGALL
           P.patens_133835         (81) QAASLGIPLSVLDDHPK-------IDLAIDGADEVDPDLNLVKGRGGALL
           P.patens_221767        (148) QAASLGIPLSVLDDHPK-------IDLAIDGADEVDPDLNLVKGRGGALL
            O.tauri_25759          (64) QAESLKIPLCTLNEKSE-------LDVAIDGADEVDPALALVKGGGGALL
     O.sativa_Os04g0306400         (94) HAARVGIPMLPLGEAGG-------IDLSIDGADEVDPELNLVKGRGGSLL
      S.officinarum_TA35800        (76) HASAVGIPLLPLDAASG-----ARIALSIDGADEVDPDLNLVKGRGGSLL
           Z.mays_TA181232         (76) HAARAGIPLLPLP---G-----ARIALSIDGADEVDPDLNLVKGRGGSLL
      S.officinarum_TA48272        (78) HATRVGIPLLPLEDAAASATGAGGIRLSIDGADEVDPDLNLVKGRGGSLL
          Z.mays_DR791617          (76) HAARVGIPLLPLDAASG-----ASIRLSIDGADEVDPDLNLVKGRGGSLL
         T.aestivum_CK211981       (77) HPARFGIPMLALADAAE-------IHLSIDGADEVDPDLNLVKGRGGSLL
       A.thaliana_AT2G01290        (93) QALSLGIPLSDLDAHPV-------IDLSIDGADEVDPFLNLVKGRGGSLL
         G.hirsutum_TA22941        (89) QAISLGIPLSDLDSHPT-------IDMAIDGADEVDPHLNLVKGRGGSLL
         G.hirsutum_TA36027        (89) QAVSLGIPLSDLDHHST-------IDLAIDGADEVDPQLNLVKGRGGSLL
         G.hirsutum_TA25911        (89) QAVSLGIPLSDLDNYPT-------IDLAIDGADEVDPHLNLVKGRGGSLL
    P.trichocarpa_VIII.1184        (93) QAVSLGIPLSDLDSHPV-------VDLAIDGADEVDSNLNLVKGRGGSLL
       P.trichocarpa_X.1083        (92) QAVSLGIPLSDLDSHPI-------VDLAIDGADEVDSNLNLVKGRGGSLL
            G.max_TA43617          (92) QALSLGIPLSDLDAHPA-------IDLAIDGADEVDPFLNLVKGRGGSLL
      P.trichocarpa_I.1144         (90) QALSLGIPLSDLDSHPV-------LDIAIDGADEIDPNLNLVKGRGGSLL
     S.lycopersicum_TA43275        (93) QAVSLGIPLSDLNKHPI-------VDLAIDGADEVDPQMNLVKGRGGSLL
                 Consensus        (151) QA SLGIPLS LD HP        IDLAIDGADEVDP LNLVKGRGGALL
```

FIGURE 4 (continued)

```
                                         201                                                250
       A.thaliana_AT1G71100        (132) REKMIEGASKKFVVIVDESKLVKYIGGSGLAVPVEVVPFCCDFTRGKLEE
       A.thaliana_AT3G04790        (148) REKMVEAVADKFIVVADDTKLVTGLGGSGLAMPVEVVQFCWNFNLIRLQD
        G.arboreum_BG444582        (147) REKMVEAASSSFIVVADDSKLVSGLGGSGLAMPVEVVQVWWNITWLDLKD
         G.arboreum_TA5822         (147) REKMVEAASSSFIVVADDSKLVSGLGGSGLAMPVEVVQFCWKYNLVRLEG
         G.hirsutum_TA26611        (147) REKMVEAASSSFIVVADDSKLVSGLGGSGLAMPVEVVQFCWKYNLVRLEG
         G.hirsutum_TA28664        (151) REKIVEAASSSFIVVADESKLVSGLGGSGLAMPVEVVQFCWKYNLIRLQG
             G.max_TA40887         (153) REKMVEAASDKFVVVDDTKLVDGLGGSGLAMPVEVVQFCWKYNLDRLQE
         P.trichocarpa_70.79       (162) REKMVEAASDEFVVVADDTKVVDGLGGSKLAMPVEVVQFCWKYNLLRLQE
       P.trichocarpa_XIII.387      (159) REKMVEAASDEFVVVADETKLVDGLGGSKLAMPVEVVQFCWKFNLVRLQE
       S.lycopersicum_TA38172      (165) REKMVEAASDKFVVVVDDSKLVSGLGGSGLAMPVEVVQFCWKYNLVRLQE
       O.sativa_Os07g0176900       (152) REKMVEAASDKFIVVVDETKLVTGLGGSGLAMPVEVVQFCWKYNQVRLQD
        S.officinarum_TA43377      (149) REKMVEAASAKFIVVVDETKLVDGLGGSGLAMPVEVVQFCWKYNLVRLQE
             Z.mays_TA182909       (147) REKMVEAASDKFIVIVDETKLVDGLGGSGLAMPVEVVQFCWKYNLVRLQE
        C.reinhardtii_55838        (136) REKMVEMASAKFVCIVDDSKLVEGLGGSKLAMPVEIVQFCHKYTLQRLAN
          P.patens_133835          (124) REKMVEAASAKFVVIVDETKLVKGLGGSKLAMPVEVVQFCWKYNAERLKN
          P.patens_221767          (191) REKMVEKASAKFVVIVDETKLVKGLGGSGLAMPVEVVQFCWKYNAERLKN
            O.tauri_25759          (107) REKMVEVMAKKFVVIVDESKLCKGLG-PGFPLPVEITPFCHMHTLRTIAK
       O.sativa_Os04g0306400       (137) REKMIEGSGGRFVVIVDESKLVPRLGCTG-AVPVEVVPFGCDHTLGLVRK
        S.officinarum_TA35800      (121) REKMIEGAGERFVVIVDESKLVPRLGCTG-AIPVEVIPFGAPHTLGLIRS
             Z.mays_TA181232       (118) REKMIEGAGARFVVIVDESKLVPRLGCTG-AIPVEVIPFGALHTLGLIRG
        S.officinarum_TA48272      (128) REKMVEGAGERFIVIVDESKLVPRLGCTG-AVPVEVIPFGAPHTLGLIRK
            Z.mays_DR791617        (121) REKMIEGAGDRFVVIVDESKLVPRLGCTG-AVPVEVIPFGAPHTLGLIRK
         T.aestivum_CK211981       (120) REKMIEGAGARFVVIVDESKLVPRLGCTG-SVPVEVVPFGSAYTLGLIRM
       A.thaliana_AT2G01290        (136) REKMIEGASKKFVVIVDDSKMVKHIGGSKLALPVEIVPFCWKFTAEKLRS
         G.hirsutum_TA22941        (132) REKMVEGACKKFVCIVDESKLVKYLGGSGLAMPVEVVPFCWKFTAKKLQN
         G.hirsutum_TA36027        (132) REKMVEGTCKKFICIVDESKLVKHLGGSGLAMPVEVVPFCWKFTANKLQN
         G.hirsutum_TA25911        (132) REKMVEGACKKFVCIVDESKLVKHLGGSGLALPVEIVPFCWKFTANKLQK
       P.trichocarpa_VIII.1184     (136) REKMIESACKKFIVIVDQSKLVAHVGASG-AMPVEVVPFCWKFSQDRLQN
         P.trichocarpa_X.1083      (135) REKMIESACKKFIVIVDESKLVPHVGACG-AMPVEVVPFCWKFTQDKLQS
             G.max_TA43617         (135) REKMVEGACKKFIVIVDESKLVNYLGGSGLAMPVEVIKFCWRFTAARLQK
       P.trichocarpa_I.1144        (133) REKMVEGVCKKFVVIVDESKLVKYIGGSGLAMPVEIVPFCWKFTAKRLQE
       S.lycopersicum_TA43275      (136) REKMVEAATKKFIVIVDESKLVNYIGGSGLAMPVEIVPFCWEFTLKRLEM
                     Consensus    (201) REKMVEAAS KFVVIVDESKLV GLGGSGLAMPVEVVPFCWKYTL RLQ
```

FIGURE 4 (continued)

```
                                              251                                           300
    A.thaliana_AT1G71100    (182) LFR-DSGCVAKLRMKIGSNGEE--------AAPAVTDNRNYVVDLYLERD
    A.thaliana_AT3G04790    (198) LFK-EFGCESKLRVDGDG------------KPYVTDNSNYIIDLYFKTP
     G.arboreum_BG444582    (197) CSK-SWVGKQSGDSKGWGG-----------KG--LRD-------------
       G.arboreum_TA5822    (197) LFK-ELGCEAKLRLAGDGS-----------EKPYVTDNMNLLGDLYFRFQ
      G.hirsutum_TA26611    (197) LFK-ELGCEAKLRLAGDGS-----------EKPYVTDNMNYIVDLYFKNP
      G.hirsutum_TA28664    (201) LFK-ELGCEAKLRLVGDGS-----------EKPYVTDNGNYIVDLYFKNP
         G.max_TA40887      (203) LFK-EEGVEAKLRLEESG------------KPYVTDNSNYIVDLYFKTP
    P.trichocarpa_70.79     (212) MFK-DEGVEAKLRAGEDG------------KPYVTDNFNYIVDLYFENP
    P.trichocarpa_XIII.387  (209) LFK-DEGVEAKLRVGEDG------------KPYVTDNFNYIVDLYFENP
    S.lycopersicum_TA38172  (215) LFK-EEGVDAKLRLDGNG------------KPYVTDNSNYIVDLYFKTP
    O.sativa_Os07g0176900   (202) LFN-DEGCEAKLRLDEGG------------KPYVTDNSNYIVDLYFKTP
    S.officinarum_TA43377   (199) LFK-EEGVEAKLRFEG-D------------KPYVTDNSNYIVDLYFKTP
        Z.mays_TA182909     (197) LFK-EEGVEAKLRFEG-D------------KPYVTDNSNYIVDLYFKTP
    C.reinhardtii_55838     (186) LPE-VKGCEAKLRMNG--------------DKPYVTDNSNYIVDLYFQTP
        P.patens_133835     (174) LPE-LAGCEVKLRMDG-D------------KPYVTDNSNYIIDLYFEEP
        P.patens_221767     (241) LPE-VAGCEVELRMDG-D------------KPYVTDNSNYIIDLYFQEP
         O.tauri_25759      (156) LPA-LAGCEAILRMGSSSNNKIDG------DNIAVTDNGNYIVDLHFKSP
    O.sativa_Os04g0306400   (186) VFDGLPGFSARLRTVASKDGEGK-------EEMFVTDNGNYIVEMFFEDG
    S.officinarum_TA35800   (170) LFDGLPGFHARLRTVPAAKGGDG------SEQPFVTDNGNYIVEMFFEDG
        Z.mays_TA181232     (167) LFDGLPGFHARLRTVPAAPAKGGEDSDSESEQPFVTDNGNYIVEMFFEDG
    S.officinarum_TA48272   (177) VFDGVPGFHARLRTVPAAKGECS-------DAPFLTDNGNYIVEMFFEDG
        Z.mays_DR791617     (170) VFDGVPGFHARLRTVPAANGEDS-------DAPFLTDNGNYIVEMFFEDG
      T.aestivum_CK211981   (169) VFDKLPGFHARLRTVKSKAGDGQ-------EELFLTDNGNHIVEMFFEDG
    A.thaliana_AT2G01290    (186) LLE-GYGCEANLRLGEKGKA----------FVTDNGNYIVDMHVEED
      G.hirsutum_TA22941    (182) LFR-DSGCVAKLRNDCKGEP-----------FVTDNGNYIVDLYLKKD
      G.hirsutum_TA36027    (182) LFE-DSGCVAKLRNDSKGP------------FVTDNGNYIVDLYLKKD
      G.hirsutum_TA25911    (182) LFQ-GSDCVAKLRNDGEGKP-----------FVTDNGNYIVDLYLKKE
    P.trichocarpa_VIII.1184 (185) LFD-YAGCVAKLRTDNGGEK-----------IFVTDNGNYIVDLFFKKD
    P.trichocarpa_X.1083    (184) LFD-YAGCVAKLRSNNGGEDGE---------IFVTDNGNYIVDLFFKKD
         G.max_TA43617      (185) LFE-EAGCVARLRTFGEKEKEE---------PYVTDNGNFIVDLYFERS
    P.trichocarpa_I.1144    (183) LFE-YAGCVAKLRTFASCNGMENG------GLPFVTDNGNYVVDLYFKRD
    S.lycopersicum_TA43275  (186) LFI-QAGCVGKLRTTGAGEDEE---------PYVTDNGNYIIDLYFKKD
                  Consensus (251) LF   GCEAKLR  G  G             PYVTDNGNYIVDLYFK
```

FIGURE 4 (continued)

```
                                          301                                                350
      A.thaliana_AT1G71100    (223)  IG-DLEVASEAILRFPGVVEHGMFLGMATTLIVAGKFGVTVKDRFG----
      A.thaliana_AT3G04790    (234)  LK-DGFAAAKEIGKFQGVVEHGLFLGMATSVIIAGKNGVEVMTK------
      G.arboreum_BG444582     (220)  --------------------------------------------------
      G.arboreum_TA5822       (235)  --------------------------------------------------
      G.hirsutum_TA26611      (235)  IK-DGFAAGKEISAMEGVVEHGLFLGMATSVIIAGKTGVEVMTK------
      G.hirsutum_TA28664      (239)  IK-DGFGAGKEISALEGVVEHGLFLGMATSVIIAGKTGIEVMTK------
      G.max_TA40887           (239)  IR-DALAAGAEISALEGVVEHGLFLNMATSVIIAGKSGVEVKAK------
      P.trichocarpa_70.79     (248)  IK-DGYAAGKEISGLEGVVEHGLFLDMATAVIIAGKTGVEVKSK-GFLIF
      P.trichocarpa_XIII.387  (245)  IK-DGYAAGKEISGLEGVVEHGLFLDMATAVIIAGKTGVEVKSK------
      S.lycopersicum_TA38172  (251)  IR-DSAAAGKEIASFEGVVEHGLFLDMTTAVIIAGKEGVSVKSK------
      C.sativa_Os07g0176900   (238)  IK-DALAAGKEISALEGVVEHGLFLDMATSVIIAGTDGVSVKTK------
      S.officinarum_TA43377   (234)  IK-DALAAGQEIAALEGVVDHGLFLNMASSVIIAGTDGVSVKTK------
      Z.mays_TA182909         (232)  IK-DALAAGQEIAALEGVVEHGLFLNMASSVIIAGTDGVSVKTK------
      C.reinhardtii_55838     (221)  IK-DSQAASKAILGLDGVVDHGLFLDMVDVCIIAGATGVTVQERPNPKKH
      P.patens_133835         (209)  IV-DANAAAQAISALEGVVDHGLFLNMASAVIIAGSDGVTVQTKDT----
      P.patens_221767         (276)  IK-DANAAAHAISALEGVVDHGLFLNMASAVIIAGSDGVTVQTKDT----
      O.tauri_25759           (199)  IK-DPVAAASQLKNCVGVVDHGLFVDMAYQVIVAGSDGIRVAGTDGEKPW
      C.sativa_Os04g0306400   (229)  IRGDLNEISDRLLRITGVVEHGMFLGMATSVVVAKKDGTVALLHKKK---
      S.officinarum_TA35800   (214)  IRGDLRDISDRLLRITGVVEHGMFLGMATTVIVANKDGTVAVMGRKK---
      Z.mays_TA181232         (217)  IRGDLRDISDRLLRITGVVEHGMFLGMATTVIVANKDGTVSVMDRKK---
      S.officinarum_TA48272   (220)  IRGDLGDISDRLLRITGVVEHGMFLGMATTLIVANKDGTVTVMNKKK---
      Z.mays_DR791617         (213)  IRGDLLDISDRLLRITGVIEHGMFLGMATTVIVANKDGTVTVINKKKMNQ
      T.aestivum_CK211981     (212)  IHGNLRDISDSLLRITGVVEHGMFLGMATKVILPHQDGTVAVLSKK----
      A.thaliana_AT2G01290    (222)  MG-DLGAVSDAILRLPGVVEHGMFLDMASTVIIAGELGVKIKNKH-----
      G.hirsutum_TA22941      (218)  IG-DLQVASDAILRIAGVVEHGMFLDMATTVIVAGELGITIKNK------
      G.hirsutum_TA36027      (218)  IG-DLQVASDAILRIAGVVEHGMFLDMATTVIVTGELGITIKNK------
      G.hirsutum_TA25911      (218)  MG-DLRVASDAILRLAGVVEHGMFLDMATTVIVAGELGITIKDK------
      P.trichocarpa_VIII.1184 (222)  IG-DLKVASDAILRLAGVVEHGMFLDMATTVIVAGELGITIKDK------
      P.trichocarpa_X.1083    (223)  VG-DLKIASDAILRLAGAVEHGMFLDMATTVIVAGELGITIKNK------
      G.max_TA43617           (224)  IG-DLKAASDAILQLAGVVEHGMFLDMATTVIVAGELGLTVKNK------
      P.trichocarpa_I.1144    (226)  IG-DLKAASDAILRLAGVVEHGMFLDMATTVIVAGDLGVTIKNKIIK---
      S.lycopersicum_TA43275  (225)  MG-DLKDASDAILRLAGVVEHGMFIDMATTVIVAGKLGVSVTNKL-----
                  Consensus   (301)  IK DL AASD ILRL GVVEHGMFL MATTVIVAG  GVTVK K
```

FIGURE 4 (continued)

```
                                       351                370
    A.thaliana_AT1G71100   (268) --------------------
    A.thaliana_AT3G04790   (277) --------------------
      G.arboreum_BG444582  (220) --------------------
        G.arboreum_TA5822  (235) --------------------
       G.hirsutum_TA26611  (278) --------------------
       G.hirsutum_TA28664  (282) --------------------
            G.max_TA40887  (282) --------------------
      P.trichocarpa_70.79  (296) MLFDALLH------------
    P.trichocarpa_XIII.387 (288) --------------------
    S.lycopersicum_TA38172 (294) --------------------
    O.sativa_Os07g0176900  (281) --------------------
      S.officinarum_TA43377(277) --------------------
          Z.mays_TA182909  (275) --------------------
      C.reinhardtii_55838  (270) --------------------
           P.patens_133835 (254) --------------------
           P.patens_221767 (321) --------------------
             O.tauri_25759 (248) W-------------------
    O.sativa_Os04g0306400  (276) --------------------
      S.officinarum_TA35800(261) --------------------
          Z.mays_TA181232  (264) --------------------
      S.officinarum_TA48272(267) --------------------
          Z.mays_DR791617  (263) AVSSTSTRGRGKVKGCGLI-
      T.aestivum_CK211981  (258) --------------------
    A.thaliana_AT2G01290   (266) --------------------
       G.hirsutum_TA22941  (261) --------------------
       G.hirsutum_TA36027  (261) --------------------
       G.hirsutum_TA25911  (261) --------------------
   P.trichocarpa_VIII.1184 (265) --------------------
      P.trichocarpa_X.1083 (266) --------------------
            G.max_TA43617  (267) --------------------
      P.trichocarpa_I.1144 (272) --------------------
    S.lycopersicum_TA43275 (269) --------------------
                 Consensus (351)
```

FIGURE 4 (continued)

IPR002653 Zinc finger, A20-type   IPR000058 Zinc finger, AN1-type

```
                               1                              30
Adoae_A20_AN1      (1) ---MAEEQ-----RCQAP---------EG
Glyma_A20_AN1 V    (1) ---MAEEH-----RCQAP------------
AT2G27580.1        (1) ---MAEEH-----RLQEP------------
Brana_A20_AN1 IV   (1) ---MSEEH-----RLQEP------------
AT2G36320.1        (1) ---MAEEH-----RCETP---------EG
Brana_A20_AN1 II   (1) ---MAEEH-----RCQTP---------EG
AT3G52800.1        (1) ---MAEEH-----RCQTP---------ES
Brana_A20_AN1 III  (1) ---MAEEH-----RCQTP---------EG
Glyma_A20_AN1 III  (1) ---MAEEH-----RCETP---------EG
Glyma_A20_AN1 VI   (1) ---MAEEH-----RCEPP---------EG
Glyma_A20_AN1 IV   (1) ---MAEEH-----RCQAP---------EG
Glyma_A20_AN1 XIV  (1) ---MAEEH-----RCQAP---------EG
Os01g56040.1       (1) ---MSSEQ-----QASAG----------Q
Os02g32840.1       (1) ---MAEEQ-----RWQEG----------C
Zeama_A20_AN1 I    (1) --MAEEQQH---QRWQE----------G
AT1G12440.1        (1) --MGSEQN---DSTSFSP---------SE
AT4G12040.1        (1) --MGSEEN---NSTSFPP---------TE
AT4G22820.1        (1) --MGSEQN---DSTSFTQSQ-------ASE
Brana_A20_AN1 I    (1) --MGSEQN---DSTSFTQ---------SSE
Tager_A20_AN1      (1) --MGSESNKMNDGTSFQP---------SE
AT4G14225.1        (1) ----------------MTG-----------E
AT4G25380.1        (1) -----------------------MVNETE
AT1G51200.1        (1) -------MDHDKTGCQSPP---------EG
Brana_A20_AN1 V    (1) -------MDHDKTGCQSPP---------EG
Glyma_A20_AN1 I    (1) ------MEPHDETGCQAP---------ER
Glyma_A20_AN1 X    (1) ------MESHDETGCQAP---------ER
Glyma_A20_AN1 IX   (1) -------MDHDKTGCQAPP---------EG
Poptr_A20_AN1 III  (1) -------MDHDETGCQAPP---------EG
Poptr_A20_AN1 IV   (1) -------MDRDETGCQAPP---------ER
Os02g10200.1       (1) -------MEHKEAGCQQP---------EG
Os06g41010.1       (1) -------MEHKETGCQQP---------EG
Zeama_A20_AN1 III  (1) -------MEHKEAGCQQP---------EG
Zeama_A20_AN1 V    (1) -------MEHKEAGCQQP---------EG
Zeama_AN13         (1) -------MEHKEAGCQAP---------EG
Lyces_A20_AN1 II   (1) -------MEQNDTGCQAP---------QA
Phypa_A20_AN1 III  (1) ---MATERVSQETTSQAP---------EG
Phypa_A20_AN1 IV   (1) ---MATERVTQETTSQTP---------EG
Os03g57890.1       (1) ---MAQESWKKEAEETGVHT-------PEA
Os07g07350.1       (1) ---MAQESWKNESEET-VHT-------PEA
Os03g57900.1       (1) MASMKRKCPDDETACGSG----------AG
Os08g33880.1       (1) ---MEEQQAAAAGGGGGG----------GG
```

FIGURE 9

| | | |
|---|---|---|
| AT3G12630.1 | (1) | ---MAQRTEK--EETEFKVLETLTT---TT |
| Medtr_A20_AN1 | (1) | ---MAQRTEN--EETEFKVVSETLQQTTTI |
| Brana_A20_AN1 VI | (1) | ---MAQGTEK--EETEFKVLETLTT---TT |
| Brana_A20_AN1 VII | (1) | ---MAQRTEK--EETEFKVLETLTTPATAT |
| Brana_A20_AN1 VIII | (1) | ---MAQRTEK--EETEFKVLESLTTPATAT |
| Glyma_A20_AN1 XV | (1) | ---MAQKTEK--EETDFKVPET-------- |
| Glyma_A20_AN1 XVI | (1) | ---MAQKTEK--EETDFKVPET-------- |
| Lyces_A20_AN1 | (1) | ---MAQRTEK--EETEFKAVPET------- |
| Poptr_A20_AN1 | (1) | ---MAQRTEK--EETECKVPEN-------- |
| Poptr_A20_AN1 II | (1) | ---MAQRAEK--EETEFKVPET-------- |
| Horvu_A20_AN1 | (1) | ---MAQRDHKQEEPTELRAPE--------- |
| Triae_A20_AN1 I | (1) | ---MAQRDHKQEEPTELRAPE--------- |
| Os09g31200.1 | (1) | ---MAQRDKKDQEPTELRAPE--------- |
| Zeama_A20_AN1 II | (1) | ---MAQRDKK-EEPTELRAPE--------- |
| Zeama_AN15 | (1) | ---MAQRDKK-EEPTELR--------APE |
| Os08g39450.1 | (1) | ---MAQREKKVEEPTELR--------APE |
| Triae_A20_AN1 II | (1) | ---MAQRDKKVEEPTEVHLH-------AAE |
| Zeama_A20_AN1 IV | (1) | ---MAQRDKKVEEPTELR--------APE |
| Zeama_AN110 | (1) | ---MAQRDKKVEEPTELR--------APE |
| Os01g52030.1 | (1) | ---MEQGSE----RQDER-----------P |
| Poptr_A20_AN1 V | (1) | ---MGSEQN---DGTSFPP---------AE |
| Consensus | (1) | MA                    P       |

FIGURE 9 (continued)

|                    |      | 31                                  | 60      |
|--------------------|------|-------------------------------------|---------|
| Adoae_A20_AN1      | (14) | HPICANNCGFFGSPATNLCSKC              | YCLK    |
| Glyma_A20_AN1 V    | (11) | -PCANNCGFFGSPATQNLCSKC              | FQLK    |
| AT2G27580.1        | (11) | -PICANNCGFFGSTATQNLCSKC             | LQHQ    |
| Brana_A20_AN1 IV   | (11) | -PICANDCGFFGNTATQNLCSKC             | LKHE    |
| AT2G36320.1        | (13) | HPICVNNCGFFGSSATNLCSNC              | LCLK    |
| Brana_A20_AN1 II   | (13) | HPICVNNCGFSGSSATNLCSNC              | LCLN    |
| AT3G52800.1        | (13) | NPICVNNCGFLGSSATNLCSNC              | LCLK    |
| Brana_A20_AN1 III  | (13) | HPICANNCGFLGNSATNLCSNC              | LCLK    |
| Glyma_A20_AN1 III  | (13) | HPICANNCGFFGSTATNLCSKC              | AIRLK   |
| Glyma_A20_AN1 VI   | (13) | HPICVNNCGFFGSTATNLCSKC              | AIRLK   |
| Glyma_A20_AN1 IV   | (13) | HPICSNNCGFFGSPATNLCSKC              | IRLK    |
| Glyma_A20_AN1 XIV  | (13) | HPICSNNCGFFGSPATNLCSKC              | IRLK    |
| Os01g56040.1       | (12) | PVLCASGCGFFGNPATDCSVC               | QHCLL   |
| Os02g32840.1       | (12) | HPICANNCGFFGSPATDLCSKC              | RQGR    |
| Zeama_A20_AN1 I    | (14) | HPICANNCGFFGSPATDLCSKC              | LYQQ    |
| AT1G12440.1        | (16) | PPICVKGCGFFGSPNNLCSKC               | IRAT    |
| AT4G12040.1        | (16) | PPICDNGCGFFGSPNNLCSKC               | SLRAE   |
| AT4G22820.1        | (19) | PPICVKGCGFFGSPNDLCSKC               | GICAE   |
| Brana_A20_AN1 I    | (17) | PPICANGCGFFGSPNDLCSKC               | ICAE    |
| Tager_A20_AN1      | (19) | PSPCANGCGFFGAATNGYCSKC              | IRVH    |
| AT4G14225.1        | (5)  | PSTCIRGCGFFSSSQTKNLCSKC             | FLKD    |
| AT4G25380.1        | (7)  | AIPCEGGCGLLGTRVNNLCSIC              | KSVLQ   |
| AT1G51200.1        | (15) | PPICINNCGFFGSAATNCSKCH              | MLFQ    |
| Brana_A20_AN1 V    | (15) | PPICINNCGFFGSAATNCSKCH              | AILFQ   |
| Glyma_A20_AN1 I    | (15) | PPICINNCGFFGRAATNCSKCH              | MLLK    |
| Glyma_A20_AN1 X    | (15) | PPICINNCGFFGRAATNCSKCH              | MLLK    |
| Glyma_A20_AN1 IX   | (15) | PPICINNCGFFGSAATNCSKCH              | MLLK    |
| Poptr_A20_AN1 III  | (15) | PPICINNCGFFGSAATNCSKCH              | GMLLK   |
| Poptr_A20_AN1 IV   | (15) | PPICINNCGFFGSAATNCSKCH              | MLLK    |
| Os02g10200.1       | (14) | PPICINNCGFFGSAATNCSKCH              | MIMK    |
| Os06g41010.1       | (14) | PPICINNCGFFGSAATNCSKCH              | MIMK    |
| Zeama_A20_AN1 III  | (14) | PPICINNCGFFGSAATNCSKCH              | MIMK    |
| Zeama_A20_AN1 V    | (14) | PPICINNCGFFGSAATNCSKCH              | MITK    |
| Zeama_AN13         | (14) | PPICINNCGFFGSAATNCSKCH              | MITK    |
| Lyces_A20_AN1 II   | (14) | PVICVNNCGFFGSAATNCSKCH              | MIFK    |
| Phypa_A20_AN1 III  | (18) | PVPCKNLCGFFGSQATGLCSKC              | TVMQ    |
| Phypa_A20_AN1 IV   | (18) | PVPCKNVCGFFGSQATGLCSKC              | TVMQ    |
| Os03g57890.1       | (21) | PPICVNNCGFFGSRMTENCSKC              | TVKA    |
| Os07g07350.1       | (20) | PPICVNNCGFFGSSMTNNCSKC              | FVKV    |
| Os03g57900.1       | (21) | AAPCVTGCGFFGSEATNNCSSC              | HSAD    |
| Os08g33880.1       | (18) | ASPCANGCGFFGSEATKKLCSKC             | QLKA    |
| A20 zinc finger|      | C          C              C   C     |         |

FIGURE 9 (continued)

A20 zinc finger domain with conserved cysteine residues

```
                               61                                    90
      Adoae_A20_AN1    (44) EE---------------QA SIKI  EKS
    Glyma_A20_AN1 V    (40) EQ---------------QS N KMV  NQS
         AT2G27580.1   (40) EQ---------------NS T KH  TQS
    Brana_A20_AN1 IV   (40) HE---------------NS T KN  KQT
         AT2G36320.1   (43) QQ---------------QQ S--------
    Brana_A20_AN1 II   (43) QQ---------------QA S--------
         AT3G52800.1   (43) QQ---------------QQ S IK TVES
    Brana_A20_AN1 III  (43) QQ---------------QQGS-----SS-
    Glyma_A20_AN1 III  (43) EQ---------------EE STKST ETA
    Glyma_A20_AN1 VI   (43) EQ---------------EE STKST ETA
    Glyma_A20_AN1 IV   (43) EE---------------EQ KTKST ETA
    Glyma_A20_AN1 XIV  (43) EE---------------EQ KTKST ETA
         Os01g56040.1  (42) NG---------------ATMATGP SSVA
         Os02g32840.1  (42) E----------------STAP- VVA
     Zeama_A20_AN1 I   (44) Q----------------------P--AGA
         AT1G12440.1   (46) EE---------------QT S KA  EKS
         AT4G12040.1   (46) ED---------------QT V KA  KNS
         AT4G22820.1   (49) EA---------------QT V KA  EKS
     Brana_A20_AN1 I   (47) EA---------------QT V KA  EKS
       Tager_A20_AN1   (49) EE---------------QA S IA  DKL
         AT4G14225.1   (35) ES---------------ARYL TFN NTK
         AT4G25380.1   (37) HS----------------------P  RFE
         AT1G51200.1   (45) QE---------------QG KFAS  SG-
     Brana_A20_AN1 V   (45) QE---------------QG RFAS  SGG
     Glyma_A20_AN1 I   (45) QE---------------QDKF AS  ENI
     Glyma_A20_AN1 X   (45) QE---------------QDNF AS  ENI
     Glyma_A20_AN1 IX  (45) QE---------------QAKL AS  GNI
     Poptr_A20_AN1 III (45) QE---------------QANL AS  GSI
     Poptr_A20_AN1 IV  (45) QE---------------QTKL AS  GSI
         Os02g10200.1  (44) EE---------------QAKL AS  DSI
         Os06g41010.1  (44) QE---------------QAKL AS  DSI
     Zeama_A20_AN1 III (44) QE---------------QAQL AS  DSI
     Zeama_A20_AN1 V   (44) QE---------------QAQL AS  DSI
         Zeama_AN13    (44) QD---------------QAKL AS  DSI
     Lyces_A20_AN1 II  (44) QE---------------QANF AS  ESF
     Phypa_A20_AN1 III (48) AK---------------MT L EQ TQAA
     Phypa_A20_AN1 IV  (48) AK---------------MT V EQ TQAA
         Os03g57890.1  (51) KT---------------VATVVEKK---P
         Os07g07350.1  (50) TT---------------MA PVVEKKAFT
         Os03g57900.1  (51) ND---------------------- EEA
         Os08g33880.1  (48) APSSPPAAPDLVANEEEASTA AA ADEQ
```

FIGURE 9 (continued)

```
    AT3G12630.1  (53) AAA--------------------GVMESG
    Medtr_A20_AN1 (56) LP----------------PSSS--------
    Brana_A20_AN1 VI  (53) AG-----------------------MDST
    Brana_A20_AN1 VII (56) AG-----------------------MDSG
    Brana_A20_AN1 VIII (56) AG-----------------------MDSG
    Glyma_A20_AN1 XV  (48) TA----------------TTSG-AGGAGIA
    Glyma_A20_AN1 XVI (45) TA----------------TTSG-AGGAGIA
    Lyces_A20_AN1     (49) TS----------------TSSSPTGTSVT
    Poptr_A20_AN1     (48) SNPS---------SSTTTTTTITFAATTN
    Poptr_A20_AN1 II  (48) SN-----------SSSSSTATSMTFAATAT
    Horvu_A20_AN1     (49) TS----------------PSSSSS----L
    Triae_A20_AN1 I   (49) TS----------------PSSSSSSSS-L
    Os09g31200.1      (49) TS-----------------S------PSSLS
    Zeama_A20_AN1 II  (48) SS----------------PTSSSSLASAA
    Zeama_AN15        (48) SS----------------SSQPSPTSPSA
    Os08g39450.1      (49) SS----------------SSAAASPSTTS
    Triae_A20_AN1 II  (51) SP----------------SSAASPPSP-S
    Zeama_A20_AN1 IV  (49) SS----------------ASSVSPPPPSS
    Zeama_AN110       (49) ------------------ASSVSPPPPSS
    Os01g52030.1      (43) QA----------------S--------APS
    Poptr_A20_AN1 V   (46) EE----------------QAASAKAMEKT
    Consensus         (61)                    A A   AV
```

FIGURE 9 (continued)

|  | | 91 | 120 |
|---|---|---|---|

```
         Adoae_A20_AN1   (58) LAGGSSS---------------SSSTAT
         Glyma_A20_AN1 V (54) LVP--------------------S-----
              AT2G27580.1 (54) LAAVGAA----------------AS---S
         Brana_A20_AN1 IV (54) LAACVAS----------------SS---S
              AT2G36320.1 (49) MKSTVE-----------------SSLSPV
         Brana_A20_AN1 II (49) LPAASP-----------------PSSS--
              AT3G52800.1 (57) SLSVSP-----------------PSSSSS
         Brana_A20_AN1 III (51) LSAVSP----------------PSPVIT
         Glyma_A20_AN1 III (57) LSSSS-----------------LKPSF
         Glyma_A20_AN1 VI (57) LSSASS-----------------AKPSS
         Glyma_A20_AN1 IV (57) LSGSS------------------SATV
         Glyma_A20_AN1 XIV (57) LSGSSA----------------TVTATA
              Os01g56040.1 (56) AASAATVATGA--------------
              Os02g32840.1 (51) AAASACPATHP--------------
         Zeama_A20_AN1 I  (49) AAGPSAPTASA--------------
              AT1G12440.1 (60) LNPNK---------------------PKT
              AT4G12040.1 (60) LKLPS-----CSII---------APGQKH
              AT4G22820.1 (63) FKPSP---PRSLFI---------AEPPAV
         Brana_A20_AN1 I  (61) FKPSPAPPPPTLFI---------AEPDVA
             Tager_A20_AN1 (63) VNKVVN-----------------FTPPPP
              AT4G14225.1 (49) AAEEVT---------------------
              AT4G25380.1 (45) PETEQAQ--------------------
              AT1G51200.1 (58) --TSSASNIIK----------------E
         Brana_A20_AN1 V  (59) --TSSASNILK----------------E
         Glyma_A20_AN1 I  (59) VNGSSNGNGKQ----------------A
         Glyma_A20_AN1 X  (59) VNGSSNGNG------------------A
         Glyma_A20_AN1 IX (59) MNGSSASTEKE----------------P
         Poptr_A20_AN1 III (59) VNGSSASNVFE----------------P
         Poptr_A20_AN1 IV (59) VNGSAASNVNE----------------P
              Os02g10200.1 (58) VNGCDGGKE-------------------H
              Os06g41010.1 (58) VNGGDSGKE-------------------P
         Zeama_A20_AN1 III (58) VNGGDNGKG------------------P
         Zeama_A20_AN1 V  (58) VNGGDGGKG------------------P
              Zeama_AN13  (58) VNGSDAVME-------------------P
         Lyces_A20_AN1 II (58) VNGSSNASVKA----------------V
         Phypa_A20_AN1 III (62) QATSATAAAVQPPA---------PVHETK
         Phypa_A20_AN1 IV (62) QVLPSAASSAQPPV---------LMEEDK
              Os03g57890.1 (62) LASLS----------------------
              Os07g07350.1 (64) PASSS----------------------
              Os03g57900.1 (58) AAANSDLELVG----------------
              Os08g33880.1 (78) LALCSAGCGFFGSKETNNMCSKCYRDHLKA
```

FIGURE 9 (continued)

```
      AT3G12630.1   (62)  SILKR ARSVNLR----------------
     Medtr_A20_AN1  (62)  -RSVR PKRSRQE----------------
   Brana_A20_AN1 VI  (59)  SILKR ARSVNLR----------------
  Brana_A20_AN1 VII  (62)  STSKR SRSVNLR----------------
 Brana_A20_AN1 VIII  (62)  STLKR SRSVNLR----------------
   Glyma_A20_AN1 XV  (61)  SPATR GISARPL----------------
  Glyma_A20_AN1 XVI  (58)  SPATR GVSARPQ----------------
      Lyces_A20_AN1 (63)  IPHNF EKLVRSE----------------
      Poptr_A20_AN1 (69)  GVSTNEILKFTSE----------------
   Poptr_A20_AN1 II (67)  SVSNNEILKFTGE----------------
      Horvu_A20_AN1 (59)  PGASV TPVLDR-----------------
    Triae_A20_AN1 I (62)  PGVSAPTPVIDR-----------------
       Os09g31200.1 (57)  SPVLDKQPPRPA-----------------
   Zeama_A20_AN1 II (62)  SQPRP ALVVDA-----------------
         Zeama_AN15 (62)  SAPAA VPQPRP-----------------
       Os08g39450.1 (63)  LPVFPVVEKPRQ-----------------
   Triae_A20_AN1 II (64)  SSPAA FPLFDK-----------------
   Zeama_A20_AN1 IV (63)  SSSSP VLQFDEQ----------------
        Zeama_AN110 (61)  SSS-P VLQFDDQ----------------
       Os01g52030.1 (49)  AAAQS EHDQV------------------
    Poptr_A20_AN1 V (60)  LNINPKQN---------------------
          Consensus (91)       S
```

FIGURE 9 (continued)

```
                                  121                           150
     Adoae_A20_AN1    (71)  SSPPLSLSSPVSLPESLSSPVVLIAPETS-
   Glyma_A20_AN1 V   (58)  P--PPAVISQPSSSSSAAVDPSSAVVDDA-
        AT2G27580.1  (64)  SVSPPPPPP-ADSKEIVEAKSEKRAAAE--
   Brana_A20_AN1 IV  (64)  VSPPPPPPPPSDLKEVNTENPEKRAAASE-
        AT2G36320.1  (61)  -IAPVLENYAAELEIPTTKKTEEKKPIQIP
   Brana_A20_AN1 II  (59)  --K--------IESISSSSTAERQIKLIP
        AT3G52800.1  (69)  EISSPIIPPLLKNPSVKLEVPEKKAVISLP
  Brana_A20_AN1 III  (63)  SISTPLIHPLVQNPSAELEITAKDVPVTIT
  Glyma_A20_AN1 III  (67)  STSPP-TLVDVLIESPPPSLAEVAVTVAV-
   Glyma_A20_AN1 VI  (68)  STSPPPSAVDVLMESPPPSAAEVEVAVTVT
   Glyma_A20_AN1 IV  (66)  AVASAVDSLPAPVESLP-----QPSVVSS-
  Glyma_A20_AN1 XIV  (70)  VVASSVESPSAPVESLP-----QPPVLIS-
        Os01g56040.1 (67)  --V---TSDSCSVPSAEVNGAAFSSKNNPE
        Os02g32840.1 (62)  --S---SPSSSSCP------AFLPSSTAAE
     Zeama_A20_AN1 I (60)  --F---QHSSAVS-------GAAAVSPDLE
        AT1G12440.1  (68)  QPQQSQEITQGVLGSGSSSS--STRGGDSA
        AT4G12040.1  (75)  PLEIKPAHLETVVVTAEPSS-VPVAAEQDE
        AT4G22820.1  (80)  VVEPKPEKAAVVVVSAEPS----SSAVPEA
     Brana_A20_AN1 I (81)  KPE-KEKAVATVLVVAEPSSATGEATVPEQ
       Tager_A20_AN1 (75)  SPSSSSGSGLVISGSETGSRSEPGPTLEPN
        AT4G14225.1  (55)  --------AQEATVLGSKG-----------
        AT4G25380.1  (52)  --------CCPPTNSPAVE-----------
        AT1G51200.1  (68)  TFTA--ALVDIETKSVEPMTVSVQPSSVQV
     Brana_A20_AN1 V (69)  TFAAT-ALVDAETKSVEPVAVSVQPSSVQV
     Glyma_A20_AN1 I (71)  VATG---AVAVQVEAVEVKIVCAQSSVDSS
     Glyma_A20_AN1 X (69)  VTTG---AVDVQVEAVEVKTVSAQSSVDSS
    Glyma_A20_AN1 IX (71)  VVAAAAANVDIPVIPVEPKTVSVQPLFGSG
   Poptr_A20_AN1 III (71)  VIAD---IIDVQNNAVEPKTITVQPSCASG
    Poptr_A20_AN1 IV (71)  VIAD---TINVQINAVEPKTITVQPSCASV
        Os02g10200.1 (68)  IVAASGS-TAVAVAQVEAKTL-VVQPTDVA
        Os06g41010.1 (68)  IIAG--H-AEVAVAQVEVKTL-VAQPAEIA
   Zeama_A20_AN1 III (68)  AIAAT---VGVAVPQVEEKTI-AVQPMHVA
     Zeama_A20_AN1 V (68)  VIAAS---VNVAVPQVEQKTI-VVQPMLVA
         Zeama_AN13  (68)  VVAGS--NTVVAVAQVELQTMNVQQPADVA
    Lyces_A20_AN1 II (70)  DVAVT---VQE--GPAESLVIPTQVAVPVE
   Phypa_A20_AN1 III (82)  LTCEVERTMIVPHQSSSYQQDLVTPAAAAP
    Phypa_A20_AN1 IV (82)  SSFEADSMLIQPPQSSSHHPVEVAPVTVAP
        Os03g57890.1 (67)  ---------STPLVTEVTDGGSGSVADGKQ
        Os07g07350.1 (69)  ---------KTPLEPAKPDEVPAAAVEDKQ
        Os03g57900.1 (69)  -------VAETTTKKARMSAVVPVAVASSS
        Os08g33880.1 (108) TSPLFSSSSSPATASTTDITVPIAPATTAP
```

FIGURE 9 (continued)

```
     AT3G12630.1   (75)  S--------SPAKVVIRP-----------
     Medtr_A20_AN1 (74)  S--------SSSSEEEGS-----------
   Brana_A20_AN1 VI (72) S--------TPARVVIRP-----------
  Brana_A20_AN1 VII (75) P--------SPAKVVIRP-----------
 Brana_A20_AN1 VIII (75) P--------TPAKVVIRP-----------
   Glyma_A20_AN1 XV (74) K-------RSFPEEPSPP-----------
  Glyma_A20_AN1 XVI (71) K-------RSFPEEPSPV-----------
     Lyces_A20_AN1 (76)  KSARFSSLRSSPDRKSDLDRMSQDLKKVGD
     Poptr_A20_AN1 (82)  KSLRSSISRSPAKDHQRQP-------K---
   Poptr_A20_AN1 II (80) KSARSSISRSLVKDPQKSP-------E---
     Horvu_A20_AN1 (71)  --------PRPAPVDAELAHPAVDYR----
    Triae_A20_AN1 I (74) --------PRPAPLEAELARPAVDL-----
       Os09g31200.1 (69) ---------APLVEPQAPLPPPVEEMA---
   Zeama_A20_AN1 II (74) --------------AAVEALAAPAAVA---
         Zeama_AN15 (74) --------------ALLDAALQLAPPA---
       Os08g39450.1 (75) ---------AVQSSAAAAVALVVERPT---
   Triae_A20_AN1 II (76) --------PRPAAAASPAAPVYMAVDR---
   Zeama_A20_AN1 IV (76) QQQQ---NPRPRAPAASGPTEEPPRPA---
        Zeama_AN110 (73) QQQQQQQNPRPRAPAASGPTEEPPR-----
       Os01g52030.1 (60) --V---LPAPEGVP--------VDEGAMP-
    Poptr_A20_AN1 V (68) IDSKVVVDAPQVVVANSVQSVVSAEASSS-
         Consensus (121)
```

FIGURE 9 (continued)

```
                        151                          1 0
Adoae_A20_AN1    (100) --------PPDSNPLPPSSSG---PSRC
Glyma_A20_AN1 V   (85) --------PRESEEVKAPQ-----QSRC
   AT2G27580.1    (91) --------PEEADG-PPQD-----PKRC
Brana_A20_AN1 IV  (93) --------PEEEEQKPPQD-----PKRC
   AT2G36320.1    (90) ----------TEQPSPPQR-----PKRCV
Brana_A20_AN1 II  (78) ----------SEQQQPPQR-----PKRCV
   AT3G52800.1    (99) ----------TTEQNQQQR-----PKRC
Brana_A20_AN1 III (93) ----------ATEQ-QQKR-----PKRC
Glyma_A20_AN1 III (95) --EAS--SSISTSSGSVAQ-----PKRC
Glyma_A20_AN1 VI  (98) VAVAS--SSISINSGSVAQ-----PKRC
Glyma_A20_AN1 IV  (90) -----------PDVAAPVQ-----AKRCA
Glyma_A20_AN1 XIV (94) -----------PDIAAPVQ-----AKRCA
   Os01g56040.1   (92) -----------PATVVEKKAP---AKRC
   Os02g32840.1   (81) -----------AGVVVAAVAK---ASRC
Zeama_A20_AN1 I   (79) -----------PPATAPAGAK---AGRC
   AT1G12440.1    (96) -----------AAPLDPPKST----ATRC
   AT4G12040.1   (104) -----------AEP-SRPVRP----NKRC
   AT4G22820.1   (106) -----------NEP-SRPART----N-RCLC
Brana_A20_AN1 I  (110) -----------NEPPSKPARP----N-RCLC
Tager_A20_AN1    (105) -----------SSTVVQVKKA----SKRC
   AT4G14225.1    (67) ----------------------GCA-
   AT4G25380.1    (63) ---------------EEPVKK------PCGI
   AT1G51200.1    (96) V-------AEVVAPEEAAKPK--GPSRC
Brana_A20_AN1 V   (98) A-------AEVVAPEAAAKLKEGPSRC
Glyma_A20_AN1 I   (98) ----------SGDSLEMKAK--TGPSRC
Glyma_A20_AN1 X   (96) ----------SGESLEMKAK--NSPSRC
Glyma_A20_AN1 IX (101) ----------PEGSGEAKLK--DGPKRC
Poptr_A20_AN1 III (98) ----------SGERVEAKPK--EGPKRC
Poptr_A20_AN1 IV  (98) ----------SGERVEAKPK--EGPSRC
   Os02g10200.1   (96) G-------TSEEVAVVPKVK--EGPKRC
   Os06g41010.1   (94) G-------PSEGVTNPKGR--EGPKRC
Zeama_A20_AN1 III (94) E-------TSEAAAVIAKAK--EGPKRC
Zeama_A20_AN1 V   (94) E-------TSEAAAVIPKAK--EGPIRCA
Zeama_AN13        (96) G-------PSEGVAAISKGGK-VGPKRCA
Lyces_A20_AN1 II  (95) -----------SEQVEKAK--EGPKRC
Phypa_A20_AN1 III (112) -------QAVKSSIAAPSRPE---PKRC
Phypa_A20_AN1 IV  (112) -------QVVVAPVATPSRPA---PKRC
   Os03g57890.1   (88) -----------VMEEDTPKPP----SKRC
   Os07g07350.1   (90) -----------AAQEP-PKPP----SKRC
   Os03g57900.1   (92) -----------SAAAEQPAAKAATAPKRCA
   Os08g33880.1  (138) TPSLKGKEEEATAAASSSAAAAAKPKRCA
AN1 zinc finger                                       C
```

AN1 zinc finger domain with
conserved cysteine and
histidine residues

FIGURE 9 (continued)

```
AT3G12630.1      (85)  -----------REIDAVKKRDQQIVNRCSG
Medtr_A20_AN1    (84)  -------TDHDLVDEKTVSEVKRVVSRCSG
Brana_A20_AN1 VI (82)  -----------REIDPVKR-DQQTIKRCSG
Brana_A20_AN1 VII(85)  -----------REIDPVKR-DQQTVNRCSG
Brana_A20_AN1 VIII(85) -----------REIDPVKR-DQQTVNRCSG
Glyma_A20_AN1 XV (85)  -------ADPPSSDQTTPSEAKRVVNRCSG
Glyma_A20_AN1 XVI(82)  -------ADPPSSDQTTPSEAKRVVNRCSG
Lyces_A20_AN1   (106)  T--MM--VKEEDQLKASLPPAKREVNRCSG
Poptr_A20_AN1   (102)  -------TASDKERSDSSSVAKKEVNRCSG
Poptr_A20_AN1 II(100)  -------TASDKERSCAYHVAKKEVNRCSG
Horvu_A20_AN1    (89)  -----------ATATEAKPARTS-VNRCSS
Triae_A20_AN1 I  (91)  -----------APATEAKPARTS-VNRCSS
Os09g31200.1     (87)  ---------SALATAPAPVAKTSAVNRCSR
Zeama_A20_AN1 II (87)  ---------AAAGQATEAAARAS-ASRCSS
Zeama_AN15       (87)  ---------AAAGQPVEASARTS-ANRCSS
Os08g39450.1     (93)  ---------AGPVESSSKASRSSSVNRCHS
Triae_A20_AN1 II (95)  ---------PAAGPADPKASKSS-VNRCHN
Zeama_A20_AN1 IV(100)  ---------RASAPAPAPASSSS-VFRCQS
Zeama_AN110      (98)  ---------PARAPAPAPASSSS-VFRCQS
Os01g52030.1     (76)  -----------PPPPRHGAKT---KSRCSA
Poptr_A20_AN1 V  (97)  ---------AETVVAGGDQVPSKPANRCFS
Consensus       (151)                         NRCST
                                               C
AN1 zinc finger
```

AN1 zinc finger domain with conserved cysteine and histidine residues

FIGURE 9 (continued)

AN1 zinc finger domain with conserved cysteine and histidine residues (cont'd)

| | | |
|---|---|---|
| AT3G12630.1 | (104) | CRK VGLTGF CRCGE FCSEH RYSER RC |
| Medtr_A20_AN1 | (107) | CR VGLAGF CRCGE FC DH RYSD R C |
| Brana_A20_AN1 VI | (100) | CRK VGLTGF CRCCD FCG EH RYSD R C |
| Brana_A20_AN1 VII | (103) | CRK VGLTGF CRCCD FCSEH RYSD R C |
| Brana_A20_AN1 VIII | (103) | CRK VGLTGF CRCCD FCSEH RYSD R C |
| Glyma_A20_AN1 XV | (108) | CR VGLTGF CRCGE FC EH RYSD R C |
| Glyma_A20_AN1 XVI | (105) | CR VGLTGF CRCGE FC EH RYSD R C |
| Lyces_A20_AN1 | (132) | CR VGLTGF CRCGE FCGH RYSD R C |
| Poptr_A20_AN1 | (125) | CR RVGLTGF CRCGE FCWEH RYSD R C |
| Poptr_A20_AN1 II | (123) | CR RVGLTGF CRCGE FCWEH RYSD R C |
| Horvu_A20_AN1 | (107) | CRKRVGLTGF CRCGD FCGEH RYSD R C |
| Triae_A20_AN1 I | (109) | CRKRVGLTGF CRCGD FCGEH RYSD R C |
| Os09g31200.1 | (108) | CRKRVGLTGF CRCGH FCGEH RYSD R C |
| Zeama_A20_AN1 II | (107) | CRKRVGLTGF CRCGE FCGAH RYSD R C |
| Zeama_AN15 | (107) | CRKRVGLTGF CRCGD FCGAH RYSD R C |
| Os08g39450.1 | (114) | CRKRVGLTGF CRCGE FCGAH RYSE R C |
| Triae_A20_AN1 II | (115) | CRKRVGLTGF CRCGE FCGAH RYSD R C |
| Zeama_A20_AN1 IV | (120) | CRKRVGLTGF CRCGD FCGAH RYSE R C |
| Zeama_AN110 | (118) | CRKRVGLTGF CRCGD FCGAH RYSE R C |
| Os01g52030.1 | (92) | CR SVGLMGF CRCGA FCGAH RYSD R C |
| Poptr_A20_AN1 V | (118) | CRKVGLTGF CRCGT FCGTH RY N C |
| Consensus | (181) | CRKRVGLTGFR CRCG LFCG HRYSDRH C |
| AN1 zinc finger | | C  C C  H  H C |

AN1 zinc finger domain with
conserved cysteine and
histidine residues (cont'd)

FIGURE 9 (continued)

```
                              211                                    238
Adoae_A20_AN1    (149)  T D  AV G R  A  A A K A N P V  I A  K L D K  -
Glyma_A20_AN1 V  (132)  E D  GM G R  Q  A K A N P V V K     K L D K  -
   AT2G27580.1   (137)    D  RM G    K  A K A N P  V K A   K L E K  -
Brana_A20_AN1 IV (140)  T D  RV G  K  K  A K A N P  V K A   K L E K  -
   AT2G36320.1   (135)  T D  SA G R  E  A K A N P  V I A A K L Q K  -
Brana_A20_AN1 II (123)    D  SA G R  E  A K A N P  V I A A K L Q K  -
   AT3G52800.1   (144)    D  SA G R  E  A K A N P  V K A A K L Q K  -
Brana_A20_AN1 III(137)  T D  SA G R  E  A K A N P  V K A A K L Q K  -
Glyma_A20_AN1 III(146)  G D  TV G R  E  A  A N P V  K A  K L R      -
Glyma_A20_AN1 VI (151)  G D  TV G R  E  A  A N P V  K A  K L R      -
Glyma_A20_AN1 IV (134)  G D  AV G R  E  A  A N P V  K   K L R       -
Glyma_A20_AN1 XIV(138)  G D  AV G R  E  A  A N P V  K   K E R       -
   Os01g56040.1  (138)  G D  G A S R  A  A  A N P   K   K L T N K I
   Os02g32840.1  (127)  G D  A A G R  A  A  A N P   K   K L K D K I
Zeama_A20_AN1 I  (125)  A D  A A G R  A  A  A N P V V K   K L K D K I
   AT1G12440.1   (142)  Q D  GV   R E A  A K A N P V V K A  K  D    -
   AT4G12040.1   (149)    D  EV G R  A  A K A N P  V K A  K  Q      -
   AT4G22820.1   (150)    D  EV G R G E  A K A N P V V K A  K  Q  F -
Brana_A20_AN1 I  (155)    D  EA G R G E  A K A N P V  K A  K L Q  F -
Tager_A20_AN1    (151)  E D  KK G R  A  A K A N P V  K A  K  D      -
   AT4G14225.1   ( 99)  PS D  SA    I V  A K Q N P V V K   K L F    -
   AT4G25380.1   (104)  P D Y K Q  G R L A  A T Q L P    A  K L Q  F -
   AT1G51200.1   (147)    N  HA A Q  A  A K A N P V V K A  K L D K  -
Brana_A20_AN1 V  (151)    N  HA A Q  A  A K A N P V V K A  K L D K  -
Glyma_A20_AN1 I  (146)  P D Y  TV G Q  A  A K A N P  V K A  K L D K  -
Glyma_A20_AN1 X  (144)  P D Y  TV G Q  A  A K A N P   K A  K L D K  -
Glyma_A20_AN1 IX (149)  P D Y  TA  R  A  A K A N P V V K A  K L D K  -
Poptr_A20_AN1 III(146)  P D Y  SA  R E A  A K A N P V V K A  K L D K  -
Poptr_A20_AN1 IV (146)  P D Y  TA  R E A  A K A N P V V K A  K L D K  -
   Os02g10200.1  (147)  Q D Y  TA  R  A  A K A N P V V K A  K L D K  -
   Os06g41010.1  (145)  Q D Y  TA  R  A  A K A N P V V K A  K L D K  -
Zeama_A20_AN1 III(145)  Q D Y  TA  R  A  A K A N P V V K A  K L D K  -
Zeama_A20_AN1 V  (145)  Q D Y  TA  R  A  A K A N P V V  A  K L D K  -
Zeama_AN13       (148)  K D Y  TA  R  A  A K A N P V V K A  K L D K  -
Lyces_A20_AN1 II (141)  P D Y  KA G Q  A  A K A N P V V K A  K L D K  -
Phypa_A20_AN1 III(162)  T D Y K A A G Q  A  A K A N P  V V A  K  V K F -
Phypa_A20_AN1 IV (162)  T D Y K A A G Q  A  A K A N P  V V A  K  V K F -
   Os03g57890.1  (134)  T D  K Q V G  E Q  A  Q N P  V K A  K  T K  -
   Os07g07350.1  (135)  T D Y  K A G  Q Q  A  Q N P V V I A K   N K  -
   Os03g57900.1  (142)  G D Y K S A G R  Q  A  Q N P  V V A  K  A T R I
   Os08g33880.1  (198)  T D  K S D P  K  A  E N P  V V A P K  T K F -
```

AN1 zinc finger domain with
conserved cysteine and
histidine residues (cont'd)

FIGURE 9 (continued)

| | | |
|---|---|---|
| AT3G12630.1 | (134) | ...DYKTAGREAIA.ENPVVKAAK.VK- |
| Medtr_A20_AN1 | (137) | G.D.KV.REE.A.ENPV..AK.VK- |
| Brana_A20_AN1 VI | (130) | .SD.KTAGREAIA.ENPVVKAAK.VK- |
| Brana_A20_AN1 VII | (133) | ..D.KTAGREAIA.ENPVVKAAK.VK- |
| Brana_A20_AN1 VIII | (133) | ..D.KTAGREAIA.ENPVVKAAKTVK- |
| Glyma_A20_AN1 XV | (138) | ..D.KAAGREAIA.ENPV.AAK.VK- |
| Glyma_A20_AN1 XVI | (135) | ..D.KAGREAIA.ENPV.AAK.VK- |
| Lyces_A20_AN1 | (162) | ..DYKTAGREAIA.ENPVVKAAK.IK- |
| Poptr_A20_AN1 | (155) | S.D.KTVGREAIA.ENPVVKAAK.V.- |
| Poptr_A20_AN1 II | (153) | ..D.KTAGREAIA.ENPVVKAAK.V.- |
| Horvu_A20_AN1 | (137) | .DY.AA.R.A.DNPVV.AAK.G.- |
| Triae_A20_AN1 I | (139) | S.D.AA.R.A.DNPVV.AAK.V.F- |
| Os09g31200.1 | (138) | S.D.KSA.R.AIA.DNPVV.AAK.V.F- |
| Zeama_A20_AN1 II | (137) | S.D.KGA.R.AIA.ENPVV.AAK.V.F- |
| Zeama_AN15 | (137) | R.D.KGA.R.AIA.ENPVV.AAK.V--- |
| Os08g39450.1 | (144) | S.D.KSA.R.A.A.ENPVV.AAK.V.F- |
| Triae_A20_AN1 II | (145) | S.D.KSA.R.AIA.ENPVV.AAK.V.F- |
| Zeama_A20_AN1 IV | (150) | C.D.KAAGR.A.A.DNPVV.AAK.V.F- |
| Zeama_AN110 | (148) | C.D.KAAGR.A.A.DNPVV.AAK.V.F- |
| Os01g52030.1 | (122) | G.DY.GAGR.A.A.ANPVV.P.KEK.- |
| Poptr_A20_AN1 V | (148) | L.D.KGAGR.A.AKANPV.KANK.E.F- |
| Consensus | (211) | SFDYK AGREAIAKANPVVKAEKL KI |

AN1 zinc finger domain with conserved cysteine and histidine residues (cont'd)

```
                                            1                                                  50
        A.thaliana_At5g59950    (1)   ----MSTGLDMSLDDMIAKNRKSRGGAGPARGTGSGS-------------
        A.thaliana_AT5G59950    (1)   ----MSTGLDMSLDDMIAKNRKSRGGAGPARGTGSGS-------------
        H.vulgare_BF2629051     (1)   ----MAETIDMSLDDIIKNNKKGNSSSGGGGRRLEGRRGSAAGGSGAASG
        H.vulgare_TA34369_45131 (1)   ----MAETIDMSLDDIIKNNKKGNSSSGGGGRREGRRGSAAGGSGAASA
                   T.aestivum_  (1)   --------------------------------------------------
        T.aestivum_TA72566_45651(1)   ----MAESLDMSLEDIIKSNKKGNSSSGGGGRREGRRG----------S
        T.aestivum_TA72565_45651(1)   ----MAESLDMSLEDIIKSNKKGNSSSGGGGRREGRLGSAAAGSG--AA
        O.sativa_Os03g0278300   (1)   ----MAETLDMTLDDIIKNNKKANPSSGRG-RRCGSAAGCGGGGGGG--VG
        Z.mays_ZM07MC203651     (1)   ----MAETLDMTLDDIIKNNKKSNPSSRGARRSRGVSAP-----------
        Z_mays_AY104617         (1)   ----MAETLDMTLDDIIKNNKKSNPSSRGARRSRGVSAP-----------
        G.max_GM06MC115191      (1)   ----MSAAMDMSLDDIIKNNKKSGSGSSRG-RTRP---------------
        M.truncatula_BG5813671  (1)   ----MSAALDMTLDDIIKNNKKSGSGNPRGGRSRPGP-------------
        M.truncatula_TA20993_38801(1) ----MSAALDMTLDDIIKNNKKSGSGNPRGGRSRPGP-------------
        G.max_GM06MC147591      (1)   ----MSAALDMTLEDIIKNNKKSSLANTRG-RGRAS--------------
        P.trichocarpa_scaff_I.16411(1)----MSSALDMSLDDIIKNSKKPGSANFRG-RGRG-H--------------
        N.tabacum_CAG26903.1    (1)   ALYMAEAALDMSLDDLIKKNKTDTGGKRRG-RGRGGA-------------
        S.lycopersicum_AW9285861(1)   ---MAGAAHDMTLDDLIKKNKTGTGGKPRG-RGRGAA-------------
        S.lycopersicum_TA41256_40811(1)---MAEAALDMTLDDLIKKNKTGTGGKPRG-RGRGAA-------------
        N.tabacum_CAG26902.1    (1)   -----MSNLDVSLDDLIKRNKSSSSRNPRPRTSGSGSGT-----------
        N.tabacum_CAJ44457.1    (1)   -----MSNLDVSLDDLIKRNKSSSSRNPRPRTSGSGS-------------
        P.trichocarpa_scaff_226.111(1)---MTTTALDMSLDDIIENNRKSSNSRGRPRS------------------
                      Consensus  (1)        MA ALDMSLDDIIKNNKKS         RG R RG
                                                     motif 2

51                                                 100
        A.thaliana_At5g59950    (34)  -----GPGPTRRNNPNRKSTRSAPYQS--AKAPESTWGHDMFSDRSEDHR
        A.thaliana_AT5G59950    (34)  -----GPGPTRRNNPNRKSTRSAPYQS--AKAPESTWGHDMFSDRSEDHR
        H.vulgare_BF2629051     (47)  GGAVGGVGPNRR-AFKRSGNRAAPYQ--PPKAPESAWQHDMYSDASAKGG
        H.vulgare_TA34369_45131 (47)  ASAVGGVGPNRR-AFKRSGNRAAPYQ--PPKAPESAWQHDMYSDASARGG
                   T.aestivum_  (1)   ----------------------------------------MYSDASARGG
        T.aestivum_TA72566_45651(37)  AAAAGGVGPNRR-AFKRSGNRAAPYQ--PPKAPESAWQHDMYSDASARGG
        T.aestivum_TA72565_45651(45)  AAAAGGVRPNRR-AFKRSGNRAAPYQ--PPKAPESAWQHDMYSDASARGG
        O.sativa_Os03g0278300   (44)  GGGGGGVGPTRR-PFKRSGNRAGPYQ--PPKAPESAWQHDMYSDVAAGGG
        Z.mays_ZM07MC203651     (36)  GGGTGGVGPTRR-PFKRAGNRQAPYQ--PPKAPDAAWQHDMYPAVAAGGG
        Z_mays_AY104617         (36)  GGGTGGVGPTRR-PFKRAGNRQAPYQ--PPKAPDAAWQHDMYPAVAAGGG
        G.max_GM06MC115191      (31)  --S--GSGPTRR-LPNRAANRAAPYA--PAKAPEATWQHDLYADQHVAAA
        M.truncatula_BG5813671  (34)  --AS-GPGPARR-ILNRAGNRAAPYS--AAKAPETTWQHDLYADQHVAAA
        M.truncatula_TA20993_38801(34)--AS-GPGPARR-ILNRAGNRAAPYS--AAKAPETTWQHDLYADQHVAAA
        G.max_GM06MC147591      (32)  -----GPGPARR-LPNRAANRAAPYA--AAKAPETAWKHDMYANQPVAAA
        P.trichocarpa_scaff_I.16411(32)--PS-GAGPARR-FPNRAANRSAPYT--AAKAPESTWQHDMFRDQ-----
        N.tabacum_CAG26903.1    (37)  --S--GPGPARR-FPNRSANRAAPYS--TAKAPEAAWNHDMFAAADQAFP
        S.lycopersicum_AW9285861(34)  --STSSAGPSQL-VPNRSANRAAPYS--IAKAPQASWNHDMFEA-DQAVA
        S.lycopersicum_TA41256_40811(34)--STSSAGPSRR-VPNRSANRAAPYS--IAKAPQASWNHDMFEA-DQAVA
        N.tabacum_CAG26902.1    (35)  --GSGGPSPRRR-FPSRAANRSAPYSSGPVHAPDSTWDHNMFAEHAPAYP
        N.tabacum_CAJ44457.1    (33)  --GSGGPGPPRR--RPNRAAKRSAPYSSGPVHAPESTWDHDMFAEHAPAYP
        P.trichocarpa_scaff_226.111(30)---SGGPGPSRR--FSNRAGNITTPYSKPQVQAPETSWQHDMFTDNPVSAS
                      Consensus  (51)    A  G GP RR   NRAGNRAAPY   KAPESAWQHDMYSD S AGG
                                                                 motif 3 and 4
```

FIGURE 15

```
                                    101                                                150
      A.thaliana_At5g59950    (77)  SGRSS-----AGIETGTKLYISNLDYGVMNEDIKELFA-EVGELKRYTVH
      A.thaliana_AT5G59950    (77)  SGRSS-----AGIETGTKLYISNLDYGVMNEDIKELFA-EVGELKRYTVH
       H.vulgare_BF2629051    (94)  GR--------RRVSAIGTGAKLFITNVDFGVSTEDLQEPFLPGWGDLKRCSIN
     H.vulgare_TA34369_45131  (94)  GG--------GRVSAIETGTKLFITNLDFGVSTEDLKELFS-ELGDLKRCSIN
               T.aestivum_    (11)  GG--------GRVSAIETGTKLLITNLDFGVSTEDLKELFS-ELGDVKRCLIH
     T.aestivum_TA72566_45651 (84)  GG--------GRVSAIETGTKLLITNLDFGVSTEDLKELFS-ELGDVKRCLIH
     T.aestivum_TA72565_45651 (92)  GG--------GRVSAIETGTKLLITNLDFGVSTEDLKELFS-ELGDVKRCLIH
       O.sativa_Os03g0278300  (91)  GGSGGG-GRVSAIETGTKLYISNLDFGVSTEDIKELFS-ELGDLKKYVIH
         Z.mays_ZM07MC203651  (83)  GG--G---GRVSALETGAKLYISNLDFGVSNEDIKELFS-ELGDLKRFSIN
                Z_mays_AY104617 (83) GG--G---GRVSALETGAKLYISNLDFGVSNEDIKELFS-ELGDLKRFSIN
         G.max_GM06MC115191   (74)  GYPAQ-GGRAASIETGTKLYISNLDYGVSNDDIKELFA-EVGDLKRHAVH
      M.truncatula_BG5813671  (78)  AYPAAQGGRAPSIETGTKLYISNLDYGVSNDDIKELFS-EVGDLKRHGVH
    M.truncatula_TA20993_38801 (78) AYPAAQGGRAPSIETGTKLYISNLDYGVSNDDIKELFS-EVGDLKRHGVH
         G.max_GM06MC147591   (74)  YPGGR----ASSIETGTKLYISNLDYGVSNDDIKELFL-EVGDVKRHTVH
    P.trichocarpa_scaff_I.16411 (71) --SGR-----TSSLEGAKLYVSNLDYGVSNEDIKELFL-EVGELKRYSIH
        N.tabacum_CAG26903.1   (80)  FGQAGGDQAASSISTGTKLYISNLDYGVSNEDIKELFS-EAGDLKRYAIH
     S.lycopersicum_AW9285861  (78)  FGQAGG--RASSIETGTKLYISNLDYGVSNEDIKELFS-EIGDLKRYAVH
  S.lycopersicum_TA41256_40811 (78)  FGQAGG--RASSIETGTKLYISNLDYGVSNEDIKELFS-EIGDLKRYAVH
        N.tabacum_CAG26902.1   (82)  AARGAGG--ISGIETGIKLLISNLDYGVSNEDIKELFS-EAGDIKRYSIH
         N.tabacum_CAJ44457.1  (79)  AARGAGG--ISGIETGIKLLISNLDYGVSNEDIKELFS-EAGDIKRYSIH
   P.trichocarpa_scaff_226.111 (76)  AYPAR----ASSIETGTKLYISNLDFGVSTEDIKELFS-EIGDLKRYSVH
                    Consensus (101) GG  A     R SSIETGT KLYISNLDYGVSNEDIKELFS ELGDLKRYSIH
                                                        motif 5

151                                                200
      A.thaliana_At5g59950    (121) FDRSGRSKGTAEVVYSRRGDALAAVKKYNDVQLDGKPMKIEIVGTNLQTA
      A.thaliana_AT5G59950    (121) FDRSGRSKGTAEVVYSRRGDALAAVKKYNDVQLDGKPMKIEIVGTNLQTA
       H.vulgare_BF2629051    (139) FDRNGR--GGTAGSFLQGGVGWCSEKEEKKTTGGS---------------
     H.vulgare_TA34369_45131  (138) FDRSGRSKGTAEVIFARRGDAVAAIKKYNNVQLDGKPMKIEILGTNTPTA
               T.aestivum_    (55)  YDRSGRSKGTAEVIFARRGDAVAALRKYNNVQLDGKPMKIEILGTNTPTA
     T.aestivum_TA72566_45651 (128) YDRSGRSKGTAEVIFARRGDAVAALRKYNNVQLDGKPMKIEILGTNTPTA
     T.aestivum_TA72565_45651 (136) YDRSGRSKGTAEVIFARRGDAVAALRKYNNVQLDGKPMKIEILXTNTPTA
       O.sativa_Os03g0278300  (139) YDRSGRSKGTAEVVFARRGDAVAAVKKYNNVQLDGKPMKIEILGTNTPTA
         Z.mays_ZM07MC203651  (128) YDRSGRSKGTAEVVFARRSDAVAAVKKYDNVQLDGKPMKIEIVGTNTPAA
                Z_mays_AY104617 (128) YDRSGRSKGTAEVVFARRSDAVAAVKKYDNVQLDGKPMKIEIVGTNTPAA
         G.max_GM06MC115191   (122) YDRSGRSKGTAEVVFSRRADAVSAVKRYNNVQLDGKPMKIEIVGTNISTP
      M.truncatula_BG5813671  (127) YDRSGRSKGTAEVVFSRRQDAVAAVKRYNNVQLDGKPMKIEIVGTNISTP
    M.truncatula_TA20993_38801 (127) YDRSGRSKGTAEVVFSRRQDAVAAVKRYNNVQLDGKPMKIEIVGTNISTP
         G.max_GM06MC147591   (119) YDRSGRSKGTAEVVFSRRADAVSAVKRYNNVQLDGKPMKVEIVGTNIATH
    P.trichocarpa_scaff_I.16411 (113) YDRSGRSKGTAEVVFARQAEAVAAVKRYNNVQLDGKPMKIEIVGTNFVAP
        N.tabacum_CAG26903.1   (129) YDRSGRSKGTAEVVFSRRQDALAAVKRYNNVQLDGKPMKIEIVGTNIATP
     S.lycopersicum_AW9285861  (125) YDRSGRSKGTAEVVFSRX--------------------------------
  S.lycopersicum_TA41256_40811 (125) YDRSGRSKGTAEVVFSRRQDAVAAVKRYNNVQLDGKPMKIEIVGTNIVTP
        N.tabacum_CAG26902.1   (129) YDKSGRSKGTAEVIFSRRRDAEAAIKKYNNVQLDGKPMKIEFAGPNIG-A
         N.tabacum_CAJ44457.1  (126) YDKSGRSKGTAEVIFSRRRDAEAAIKKYNNVQLDGKPMKIEFAGPNIG-A
   P.trichocarpa_scaff_226.111 (121) YDRSGRSEGTAEIVFARREDAVSAVKRYNNVQLDGKPMKIEIVGTNIATR
                    Consensus (151) YDRSGRSKGTAEVVFSRRGDAVAAVKKYNNVQLDGKPMKIE IVGTNI TA
```

FIGURE 15 (continued)

```
                                              201                                                250
         A.thaliana_At5g59950     (171)  --AAPSGRPANGN--SNGAPWRGGQGRGGQQRGGGRGGGGRGGGGRGRRP
         A.thaliana_AT5G59950     (171)  --AAPSGRPANGN--SNGAPWRTRERRS-TTRWWTRRRWPRWWWSW----
           H.vulgare_BF2629051    (172)  --------------------------------------------------
        H.vulgare_TA34369_45131   (188)  PAALPTNNGSYARNVAKSAPRGVS-ASLPQNRPRARGGRGRGGGGGGG--
                    T.aestivum_   (105)  PAALPTNNGTYARNVAKSAPRGVS-ASLPQNRPRARGGRGRRGGGGG---
        T.aestivum_TA72566_45651  (178)  PAALPTNNGTYARNVAKSAPRGVS-ASLPQNRPRARGGRGRRGGGGG---
        T.aestivum_TA72565_45651  (186)  PAALPTNNGTYA--------------------------------------
         O.sativa_Os03g0278300    (189)  AAALPANNGGYVRNVAKSAPRGGP-AGLPQGRPRPRGGGRRRGGGGGSGG
           Z.mays_ZM07MC203651    (178)  AAAHPVPNGGHARNAARSAPKDAAPAGMSQHRTHQRGGRRAAGSGGG---
              Z_mays_AY104617     (178)  ASAHPVPNGGHARNAARSAPKDAAPAGMSQHRTHQRGGRRAAGSGGG---
           G.max_GM06MC115191     (172)  G-VAPAPNGAIGN--FNGVPR-SGQGRGGALRRP--GGRGQG-IRRDRGR
         M.truncatula_BG5813671   (177)  G-AAPVVNAPIGN--FNGIPQ-SGQGRVGEFRGP--GGRGQG-IRRNRDV
        M.truncatula_TA20993_38801(177)  G-AAPVVNAPIGN--FNGIPQ-SGQGRVGEFRGP--GGRGQG-IRRNRGR
           G.max_GM06MC147591     (169)  A-APPAVNGTFGN--PTGVPR-SGQGRSGSLGRPRGGSRGRGSIQRGRGR
       P.trichocarpa_scaff_I.16411(163)  P-APPAANAAFGN--SNGVSG-R---------------------------
           N.tabacum_CAG26903.1   (179)  --AAPAFNGAFGFGDTNGGPR-TDQARSGGFGRSR-GGRGRGRGFRGGSR
         S.lycopersicum_AW9285861 (143)  --------------------------------------------------
        S.lycopersicum_TA41256_40811(175) --TAPFSNGAFGFGDTNGAPR-SGQVRGGGFGRSR-GGKGRDRGFRGGNR
           N.tabacum_CAG26902.1   (178)  P-TLPPLRNRLYRNPNPAP---RSQQRGGGFRRPPRGGRGSMRKEGGRGR
           N.tabacum_CAJ44457.1   (175)  P-ALPPIRNRLYRNPNPAP---RSQQRGGGFRRPPRGGRGSMRKEGGRGR
       P.trichocarpa_scaff_226.111(171)  P-AVPPSTNGMYRNQNIAAPRSSSQGRGGTTGRPRGGGHGVRRGGRGRGR
                     Consensus    (201)       A P  NG  G       GAPR    AR   R   GGRG      G 251                                                300
         A.thaliana_At5g59950     (217)  GKG----P-----------AEKISAEDLDADLDKYHSGDMETN------
         A.thaliana_AT5G59950     (212)  --------------------------------------------------
           H.vulgare_BF2629051    (172)  --------------------------------------------------
        H.vulgare_TA34369_45131   (235)  -SGSG-------GRRGKERSQPR-SAEELDAELEKYHAQGAAPMQTNE--
                    T.aestivum_   (151)  -SGSG-------GRRGKERSQPR-SAEELDAELEKYHAQGTTPMQTTE--
        T.aestivum_TA72566_45651  (224)  -SGSG-------GRRGKERSQPR-SAEELDAELEKYHAQGTTPMQTTE--
        T.aestivum_TA72565_45651  (198)  --------------------------------------------------
         O.sativa_Os03g0278300    (238)  PGGSG-------GRRGKERSQPK-SAEELDADLEKYHADAMQTN------
           Z.mays_ZM07MC203651    (225)  ------------RRGKERSKPK--STEELDADLEKYHADAMQTNIHSQIY
              Z_mays_AY104617     (225)  ------------RRGKERRSQSRLKNSMLIWRSIMLMRCRPTKYIHKFDI
           G.max_GM06MC115191     (215)  GRG----RGG---GGRG----EKVSADDLDADLEKYHAEAMQLN------
         M.truncatula_BG5813671   (220)  EELAVDPPVGVLFEGPG---------------------------------
        M.truncatula_TA20993_38801(220)  GRGSGGPRGGGRGGGRGRGRDDKVSAEDLDAELEKYHAEAMQLN------
           G.max_GM06MC147591     (215)  GRG------S---------RDEKVSAEDLDADLEKYHAEAMQLN------
       P.trichocarpa_scaff_I.16411(182)  --------------------------------------------------
           N.tabacum_CAG26903.1   (225)  GRGRG---D----------RGEKVSAEDLDADLMKYHTEAMQTN------
         S.lycopersicum_AW9285861 (143)  --------------------------------------------------
        S.lycopersicum_TA41256_40811(221) GWGRG---G----------RGEKVSAEDLDADLMKYHTEAMQTN------
           N.tabacum_CAG26902.1   (224)  GRV----------------ENITAEDLDADLEKYHAEAMQTN------
           N.tabacum_CAJ44457.1   (221)  GRG----------------ENISAEDLDADLEKYHSEAMETN------
       P.trichocarpa_scaff_226.111(220)  GRG----------------EKISAEDLDADLEKYHSEAMQEN------
                     Consensus    (251)       G                K  SAEDLDADLEKYHA AM N
                                                                    motif 1
```

FIGURE 15 (continued)

```
                                    301                                           350
A.thaliana_At5g59950      (245) --------------------------------------------------
A.thaliana_AT5G59950      (212) --------------------------------------------------
H.vulgare_BF2629051       (172) --------------------------------------------------
H.vulgare_TA34369_45131   (274) --------------------------------------------------
T.aestivum_               (190) --------------------------------------------------
T.aestivum_TA72566_45651  (263) --------------------------------------------------
T.aestivum_TA72565_45651  (198) --------------------------------------------------
O.sativa_Os03g0278300     (274) --------------------------------------------------
Z.mays_ZM07MC203651       (261) STSNIKRISPPIQLFVL---------------------------------
Z_mays_AY104617           (263) RHQISSALVLPLQLYVLPCSGDNKPFLWGRGYCFTEYCGFYVYTIELELG
G.max_GM06MC115191        (248) --------------------------------------------------
M.truncatula_BG5813671    (237) --------------------------------------------------
M.truncatula_TA20993_38801(264) --------------------------------------------------
G.max_GM06MC147591        (244) --------------------------------------------------
P.trichocarpa_scaff_I.16411 (182) ------------------------------------------------
N.tabacum_CAG26903.1      (256) --------------------------------------------------
S.lycopersicum_AW9285861  (143) --------------------------------------------------
S.lycopersicum_TA41256_40811 (252) -----------------------------------------------
N.tabacum_CAG26902.1      (250) --------------------------------------------------
N.tabacum_CAJ44457.1      (247) --------------------------------------------------
P.trichocarpa_scaff_226.111 (246) ------------------------------------------------
               Consensus  (301)

351
A.thaliana_At5g59950      (245) --
A.thaliana_AT5G59950      (212) --
H.vulgare_BF2629051       (172) --
H.vulgare_TA34369_45131   (274) --
T.aestivum_               (190) --
T.aestivum_TA72566_45651  (263) --
T.aestivum_TA72565_45651  (198) --
O.sativa_Os03g0278300     (274) --
Z.mays_ZM07MC203651       (278) --
Z_mays_AY104617           (313) DA
G.max_GM06MC115191        (248) --
M.truncatula_BG5813671    (237) --
M.truncatula_TA20993_38801(264) --
G.max_GM06MC147591        (244) --
P.trichocarpa_scaff_I.16411 (182) --
N.tabacum_CAG26903.1      (256) --
S.lycopersicum_AW9285861  (143) --
S.lycopersicum_TA41256_40811 (252) --
N.tabacum_CAG26902.1      (250) --
N.tabacum_CAJ44457.1      (247) --
P.trichocarpa_scaff_226.111 (246) --
               Consensus  (351)
```

PLANTS HAVING ENHANCED YIELD-RELATED TRAITS AND A METHOD FOR MAKING THE SAME BY OVEREXPRESSING A POLYNUCLEOTIDE ENCODING A TFL1-LIKE PROTEIN

RELATED APPLICATIONS

This application is a national stage application (under 35 U.S.C. §371) of PCT/EP2009/058310, filed Jul. 2, 2009, which claims benefit of European application 08159749.4, filed Jul. 4, 2008; U.S. Provisional Application 61/078,499, filed Jul. 7, 2008; European Application 08159946.6, filed Jul. 8, 2008; U.S. Provisional Application 61/079,158, filed Jul. 9, 2008; European Application 08160152.8, filed Jul. 10, 2008; European Application 08160149.4, filed Jul. 10, 2008; U.S. Provisional Application 61/079,817, filed Jul. 11, 2008; U.S. Provisional Application 61/079,868, filed Jul. 11, 2008; European Application 08160632.9, filed Jul. 17, 2008 and U.S. Provisional Application 61/081,923 filed on Jul. 18, 2008.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Sequence_Listing_13987_00136_US. The size of the text file is 746 KB, and the text file was created on Dec. 29, 2010.

The present invention relates generally to the field of molecular biology and concerns a method for enhancing various yield-related traits by modulating expression in a plant of a nucleic acid encoding a TFL1_like (Terminal Flower Like 1) polypeptide. The present invention also concerns plants having modulated expression of a nucleic acid encoding a TFL1_like polypeptide, which plants have enhanced yield-related traits relative to corresponding wild type plants or other control plants. The invention also provides hitherto unknown TFL1_Like encoding nucleic acids, and constructs comprising the same, useful in performing the methods of the invention.

Furthermore, the present invention relates generally to the field of molecular biology and concerns a method for improving various plant yield-related traits by modulating expression in a plant of a nucleic acid encoding a R5PI (D-Ribose-5-phosphate isomerase). The present invention also concerns plants having modulated expression of a nucleic acid encoding a R5PI polypeptide, which plants have improved yield-related traits relative to corresponding wild type plants or other control plants. The invention also provides constructs useful in the methods of the invention.

Even furthermore, the present invention relates generally to the field of molecular biology and concerns a method for increasing various plant yield-related traits by increasing expression in a plant of a nucleic acid sequence encoding a zinc finger (Znf) domain-containing A20/AN1 polypeptide. The present invention also concerns plants having increased expression of a nucleic acid sequence encoding a Znf A20/AN1 polypeptide, which plants have increased yield-related traits relative to control plants. The invention also provides nucleic acid sequence, polypeptide sequence, and constructs useful in the methods of the invention.

Furthermore, the present invention relates generally to the field of molecular biology and concerns a method for increasing various plant seed yield-related traits by increasing expression in a plant of a nucleic acid sequence encoding a plant homeodomain zinc finger (PHD-zf) polypeptide. The present invention also concerns plants having increased expression of a nucleic acid sequence encoding a PHD-zf polypeptide, which plants have increased seed yield-related traits relative to control plants. The invention additionally relates to nucleic acid sequences, nucleic acid constructs, vectors and plants containing said nucleic acid sequences.

Furthermore, the present invention relates generally to the field of molecular biology and concerns a method for enhancing yield-related traits by modulating expression in a plant of a nucleic acid encoding a REF/ALY (RNA and Export Factor-binding protein; also known as ALY). The present invention also concerns plants having modulated expression of a nucleic acid encoding a REF/ALY polypeptide which plants have improved yield-related traits relative to corresponding wild type plants or other control plants. The invention also provides constructs useful in the methods of the invention.

The ever-increasing world population and the dwindling supply of arable land available for agriculture fuels research towards increasing the efficiency of agriculture. Conventional means for crop and horticultural improvements utilise selective breeding techniques to identify plants having desirable characteristics. However, such selective breeding techniques have several drawbacks, namely that these techniques are typically labour intensive and result in plants that often contain heterogeneous genetic components that may not always result in the desirable trait being passed on from parent plants. Advances in molecular biology have allowed mankind to modify the germplasm of animals and plants. Genetic engineering of plants entails the isolation and manipulation of genetic material (typically in the form of DNA or RNA) and the subsequent introduction of that genetic material into a plant. Such technology has the capacity to deliver crops or plants having various improved economic, agronomic or horticultural traits.

A trait of particular economic interest is increased yield. Yield is normally defined as the measurable produce of economic value from a crop. This may be defined in terms of quantity and/or quality. Yield is directly dependent on several factors, for example, the number and size of the organs, plant architecture (for example, the number of branches), seed production, leaf senescence and more. Root development, nutrient uptake, stress tolerance and early vigour may also be important factors in determining yield. Optimizing the above-mentioned factors may therefore contribute to increasing crop yield.

Seed yield is a particularly important trait, since the seeds of many plants are important for human and animal nutrition. Crops such as corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from the roots, leaves and stems into the growing seed. The endosperm, in particular, assimilates the metabolic precursors of carbohydrates, oils and proteins and synthesizes them into storage macromolecules to fill out the grain.

Plant biomass is yield for forage crops like alfalfa, silage corn and hay. Many proxies for yield have been used in grain crops. Chief amongst these are estimates of plant size. Plant size can be measured in many ways depending on species and developmental stage, but include total plant dry weight, above-ground dry weight, above-ground fresh weight, leaf area, stem volume, plant height, rosette diameter, leaf length, root length, root mass, tiller number and leaf number. Many species maintain a conservative ratio between the size of different parts of the plant at a given developmental stage. These allometric relationships are used to extrapolate from one of these measures of size to another (e.g. Tittonell et al 2005 Agric Ecosys & Environ 105: 213). Plant size at an early developmental stage will typically correlate with plant size later in development. A larger plant with a greater leaf area can typically absorb more light and carbon dioxide than a smaller plant and therefore will likely gain a greater weight during the same period (Fasoula & Tollenaar 2005 Maydica 50:39). This is in addition to the potential continuation of the micro-environmental or genetic advantage that the plant had to achieve the larger size initially. There is a strong genetic component to plant size and growth rate (e.g. ter Steege et al 2005 Plant Physiology 139:1078), and so for a range of diverse genotypes plant size under one environmental condition is likely to correlate with size under another (Hittalmani et al 2003 Theoretical Applied Genetics 107:679). In this way a standard environment is used as a proxy for the diverse and dynamic environments encountered at different locations and times by crops in the field.

Another important trait for many crops is early vigour. Improving early vigour is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigour into plants would be of great importance in agriculture. For example, poor early vigour has been a limitation to the introduction of maize (Zea mays L.) hybrids based on Corn Belt germplasm in the European Atlantic.

Harvest index, the ratio of seed yield to aboveground dry weight, is relatively stable under many environmental conditions and so a robust correlation between plant size and grain yield can often be obtained (e.g. Rebetzke et al 2002 Crop Science 42:739). These processes are intrinsically linked because the majority of grain biomass is dependent on current or stored photosynthetic productivity by the leaves and stem of the plant (Gardener et al 1985 Physiology of Crop Plants. Iowa State University Press, pp 68-73). Therefore, selecting for plant size, even at early stages of development, has been used as an indicator for future potential yield (e.g. Tittonell et al 2005 Agric Ecosys & Environ 105: 213). When testing for the impact of genetic differences on stress tolerance, the ability to standardize soil properties, temperature, water and nutrient availability and light intensity is an intrinsic advantage of greenhouse or plant growth chamber environments compared to the field. However, artificial limitations on yield due to poor pollination due to the absence of wind or insects, or insufficient space for mature root or canopy growth, can restrict the use of these controlled environments for testing yield differences. Therefore, measurements of plant size in early development, under standardized conditions in a growth chamber or greenhouse, are standard practices to provide indication of potential genetic yield advantages.

A further important trait is that of improved abiotic stress tolerance. Abiotic stress is a primary cause of crop loss worldwide, reducing average yields for most major crop plants by more than 50% (Wang et al., Planta (2003) 218: 1-14). Abiotic stresses may be caused by drought, salinity, extremes of temperature, chemical toxicity and oxidative stress. The ability to improve plant tolerance to abiotic stress would be of great economic advantage to farmers worldwide and would allow for the cultivation of crops during adverse conditions and in territories where cultivation of crops may not otherwise be possible.

Crop yield may therefore be increased by optimising one of the above-mentioned factors.

Depending on the end use, the modification of certain yield traits may be favoured over others. For example for applications such as forage or wood production, or bio-fuel resource, an increase in the vegetative parts of a plant may be desirable, and for applications such as flour, starch or oil production, an increase in seed parameters may be particularly desirable. Even amongst the seed parameters, some may be favoured over others, depending on the application. Various mechanisms may contribute to increasing seed yield, whether that is in the form of increased seed size or increased seed number.

One approach to increasing yield (seed yield and/or biomass) in plants may be through modification of the inherent growth mechanisms of a plant, such as the cell cycle or various signalling pathways involved in plant growth or in defense mechanisms.

It has now been found that yield-related traits may be improved in plants by modulating expression in a plant of a nucleic acid encoding a TFL1-like in a plant.

Furthermore, it has now been found that various yield-related traits may be improved in plants by modulating expression in a plant of a nucleic acid encoding a R5PI (D-Ribose-5-phosphate isomerase) in a plant.

Even furthermore, it has now been found that various yield-related traits may be increased in plants relative to control plants, by increasing expression in a plant of a nucleic acid sequence encoding a zinc finger (Znf) domain-containing A20/AN1 polypeptide. The increased yield-related traits comprise one or more of: increased early vigour, increased aboveground biomass, increased total seed yield per plant, increased number of filled seeds, increased seed filling rate, and increased harvest index.

Yet furthermore, it has now been found that various seed yield-related traits may be increased in plants relative to control plants, by increasing expression in a plant of a nucleic acid sequence encoding a a plant homeodomain zinc finger (PHD-zf) polypeptide. The increased seed yield-related traits comprise one or more of: increased plant height, increased seed fill rate, increased number of flowers per panicles, and increased Thousand Kernel Weight (TKW).

Furthermore, it has now been found that various growth characteristics may be improved in plants by modulating expression in a plant of a nucleic acid encoding a REF/ALY (RNA and Export Factor-binding protein; also known as ALY) in a plant.

BACKGROUND

1. TFL1-Like Polypeptides

Successful reproduction in flowering plants involves the transition from vegetative to the reproductive stage (Baurle and Dean, 2006 Cell, 125, 655-664.). The switch to flowering involves the integration of developmental as well as environmental signals resulting in the generation of floral meristems. Floral meristems arise from the shoot meristem which harbours the stem cells that provide key growing points in plants. The production of a flower from a floral meristem depends on the maintenance of an appropriate balance between meristematic activity and organogenesis. During flower development, this balance is shifted towards organogenesis, causing the floral meristem to terminate after producing a genetically determined number of flowers. Successful completion of reproduction leading to fruit and/or seed production further requires the coordinated development of male and female organs to achieve pollination and seed set. Several dozens of genes affect transition from vegetative to floral phase and successful reproduction in plants, but only a few have been shown to play a critical role in these processes. Members of the PEBP (phosphatidylethanolamine-binding protein) gene family act on the control of flowering time and determination of the fate of inflorescence meristem and plant architecture.

The PEBP gene family is a highly conserved group of proteins that have been identified in numerous tissues in a wide variety of organisms, including bacteria, yeast, nematodes, plants, *drosophila* and mammals. In plants, the PEBP gene family consists of three main homology classes (the so-called TFL1-LIKE, MFT-LIKE, and FT-LIKE subfamilies (Chardon and Damerval, J Mol Evol. 2005, 61(5):579-90). Despite the high conservation in amino acid sequence amongst the proteins encoded by PEBP gene family, members of the TFL1-like and FT-like subfamilies act in an opposite manner. TFL is a repressor of flowering whereas FT is an activator (Kardailsky et al. (1999) Science 286, 1962-1965; Kobayashi, et al. (1999) Science 286, 1960-1962). Notwithstanding the above, gain-of-function studies attributed the TFL1 and FT functional difference to the protein sequence rather than to the expression pattern (Kardailsky, et al., 1999; Kobayashi et al., 1999; Ratcliffe, et al. (1998) Development 125, 1609-1615). Structural studies identified conserved key residues that unambiguously distinguish FT and TFL functional homologs (Ahn et al. 2006. EMBO, 25, 605-614). TFL1-like genes (also referred to as TFL genes) have been identified and cloned from several plants species including the homologous CENTRORADIALIS (CEN) gene of Antirrhinum gene and several homologues from maize (Danilevskaya et al 2008 Plant Physiol. 2008; 146(1):250-64.). In *Arabidopsis thaliana*, the TFL1-like family is composed of three genes, TFL1, ATC (*Arabidopsis thaliana* Centroradialis homologue) and BFT (Brother of FT). Specific expression patterns for the TFL1-like isoforms have been described in *Arabidopsis thaliana*. However, functional redundancy between TFL1 and ATC was revealed by the similar effects caused when overexpressed in transgenic plants (Mimida et al. 2001 Genes Cells. 2001 6(4):327-36). TFL1-like homologous genes recently identified in the genome of grapevine cluster in three subclades related to *Arabidopsis* BFT, TFL1 and ATC (Carmona et al. 2007, Plant Mol Biol (2007) 63:637-650). All TFL1-like isoforms present in grapevine bear conserved, charged residues His88 and Asp144 in similar positions to TFL1 as well as the characteristic amino acid triad ENE, END and DNG for VvTFL1A, VvTFL1B and VvTFL1C respectively. Phylogenetic analysis used by Igasaki et al. 2008 (Plant Cell Physiol. 49(3): 291-300) to classify members of the FT/TFL1 family revealed that the proteins in the BFT clade and TFL1 clade are closer related to each other than to any of the MFT (Mother of FT) or FT clades.

Constitutive overexpression of rice TFL1/CEN homologs in rice plants under the control of a viral derived promoter extended the vegetative growth phase of the plants. In addition the altered panicle morphology and retardation of panicle development resulted in the production of immature flowers hindering pollination and seed set (Nakawaga 2002, The Plant Journal, (2002), 29, 743-750). Several other means and methods for altering flowering time, increase in vegetative growth and/or altered branching by manipulation of TFL1 levels in a plant have been described (patent application US2006/0070141, U.S. Pat. Nos. 6,573,430 and 6,025,543). However, such experiments did not result in enhancement of seed-related traits. For application of such technology in agronomically important seed crops such as wheat, barley, rice, forage grasses, and other monocotyledonous plants there is, on the one hand, a need to prevent putative negative impact on seed production, caused by for example a delay in the maturity of inflorescence and other reproductive organs preventing seed set and on the other hand it would be desirable to improve seed-related traits such as the number of seeds, seed filling and weight of harvested seeds.

Surprisingly, it has now been found that modulating expression of a nucleic acid encoding a TFL1-like polypeptide gives plants having enhanced yield-related traits in particular increased plant seed yield relative to control plants.

According one embodiment, there is provided a method for enhancing yield-related traits relative to control plants, comprising modulating expression of a nucleic acid encoding a TFL1-like polypeptide in a plant.

2. Ribose 5-Phosphate Isomerase (R5PI)

Ribose 5-phosphate isomerase (R5PI) is an enzyme catalysing the reversible conversion of Ribose-5-phosphate to Ribulose-5-Phosphate.

Ribose 5-phosphate isomerase is ubiquitous to all living cells. In plants, Ribose 5-phosphate is a product of the oxidative pentose phosphate pathway located in both in cytosol and in plastids, while Ribulose-5-Phosphate is an essential part of the Calvin cycle in chloroplasts. Consistently, isoforms of Ribose 5-phosphate isomerase are found both in the cytosol and also in the chloroplast of plant cells. In the chloroplast the enzyme has been shown to function in a five-enzyme protein complex.

Many compounds are ultimately derived from R5P such as 3PGA, 3-phosphoglycerate; Xyl-5P, xylulose 5-phosphate and Ru1,5bisP, ribulose 1,5-bis-phosphate. Therefore R5PI enzyme plays a central role in plant cell metabolism with effects on the synthesis of nucleic acids, coenzymes such as NADH, NADPH, FAD, Vitamin B12, and other aromatic compounds.

A mutation in ribose 5-phosphate isomerase was reported to reduce cellulose synthesis in *Arabidopsis thaliana* (Howles et al; 2006)

Surprisingly, it has now been found that modulating expression of a nucleic acid encoding a R5PI polypeptide gives plants having enhanced yield-related traits relative to control plants.

According one embodiment, there is provided a method for enhancing yield related traits of a plant relative to control plants, comprising modulating expression of a nucleic acid encoding a R5PI polypeptide in a plant.

3. Zinc Finger (Znf) Domain-Containing A20/AN1 Polypeptide

Protein-protein and protein-nucleic acid interactions are essential functions of many proteins. Proteins have developed different ways to bind other molecules. Zinc-binding repeats, known as zinc finger domain (ZnF), are one such molecular scaffold. Proteins containing zinc finger domain(s) have been found to play important roles in eukaryotic cells regulating different signal transduction pathways and controlling processes, such as development and programmed cell death. The zinc finger domain enables different proteins to interact with or bind DNA, RNA, or other proteins, and is present in the proteomes of many different organisms. There are many types of zinc finger domain containing proteins, classified according to the number and order of the cysteine (Cys) and histidine (His) residues that bind the zinc atom(s).

One class of zinc finger domain-containing proteins is the A20/AN1 subfamily, characterized by the presence of at least two zinc finger domains: an A20 zinc finger domain (usually C-terminal), and an AN1 zinc finger domain (usually N-terminal). The A20 zinc finger-domain was first identified for its role in regulating immune response in mammalian systems (Opipari et al. (1990) J boil Chem 265:14705-14708). It is characterized by the presence of multiple Cys2/Cys2 finger motifs, binds a single zinc atom and is involved in ubiquitin signalling by displaying ubiquitin ligase activity (Hishiya et al. (2006) EMBO J 25: 554-564). The AN1 zinc finger domain was first identified as a zinc finger at the C-terminus of AN1, a ubiquitin-like protein in *Xenopus laevis* (Linnen et al. (1993) Gene 128: 181-188). It is characterized by the presence of six conserved Cys and two His that could potentially coordinate 2 zinc atoms.

In plants, genes encoding ZnF A20/AN1 proteins are part of a multigene family with at least 14 members in *Arabidopsis thaliana*, at least 18 members in rice, at least 19 in poplar and at least 10 in *Physcomitrella patens* (Shubha & Tyagi (2008) Funct Integr Genomics). Domain organization analysis of these polypeptides reveals a wide diversity in domain organization, with up to seventeen different classes identified. One of these classes is the class of polypeptides comprising at least one of each: an A20 zinc finger domain and an AN1 zinc finger domain (Shubha & Tyagi (2008) supra).

Transgenic rice and tobacco plants transformed with a rice Znf A20/AN1 polypeptide (OsSAP8) under the control of a constitutive ubiquitin promoter displayed increased tolerance to salt, drought, and cold stress at seed germination/seedling stage. Transgenic rice plants were tolerant to salt and drought during anthesis stage without yield penalty as compared to unstressed transgenic plants (Kanneganti & Gupta (2008) Plant Mol Biol 66: 445-462).

In EP patent application EP1033405, an *Arabidopsis thaliana* Znf A20/AN1 polypeptide is identified as SEQ ID NO: 10503, and corresponding nucleic acid sequence as SEQ ID NO: 10502. In U.S. Pat. No. 7,214,786, a *Triticum aestivum* Znf A20/AN1 polypeptide is identified as SEQ ID NO: 10787 of 211,164 sequences.

Surprisingly, it has now been found that increasing expression of a nucleic acid sequence encoding a zinc finger (Znf) domain-containing A20/AN1 polypeptide gives plants having increased yield-related traits relative to control plants.

According to one embodiment, there is provided a method for increasing yield-related traits in plants relative to control plants, comprising increasing expression of a nucleic acid sequence encoding a zinc finger (Znf) domain-containing A20/AN1 polypeptide in a plant. The increased yield-related traits comprise one or more of: increased early vigour, increased aboveground biomass, increased total seed yield per plant, increased number of filled seeds, increased seed filling rate, and increased harvest index.

4. PHD-zf Polypeptide

Zinc finger (zf) domain-containing proteins are among the most abundant proteins in eukaryotic genomes. Zinc finger proteins can bind to DNA, RNA, other proteins, or lipids as a modular domain in combination with other conserved structures. Owing to this combinatorial diversity, different members of zinc finger superfamilies contribute to many distinct cellular processes, including transcriptional regulation, mRNA stability and processing, and protein turnover. Zinc finger domains are relatively small protein motifs that bind one or more zinc ions, which zinc ion is tetrahedrally coordinated by cysteines and histidines.

Zinc finger domain-containing proteins can be classified into evolutionary and functionally divergent protein subfamilies. One of these subfamilies is the plant homeodomain zinc finger (PDH-zf) domain family, named after the class of proteins (plant homeodomain) in which they were first found (Aasland & Stewart (1995) Trends Biochem Sci 20:56-9). The PHD is an approximately 50-amino acid motif found mainly in proteins involved in eukaryotic transcription regulation. The characteristic sequence feature is a conserved $Cys_4$-$HisCys_3$ zinc binding motif. PHD domains coordinate two zinc atoms, and One of the founding members, named Alfin-1 (alfalfa-induced-1), was originally isolated by differential screening of a cDNA library between salt-tolerant and normal alfalfa cells (Bastola, et al. (1998) Plant Mol Biol 38:1123-35). It was speculated that the Alfin-1 PHD domain plays the role of binding DNA in an EDTA-sensitive manner inferring the need for zinc for binding (Bastola, et al., 1998, supra). Eight PHD-zf encoding genes were identified in *Arabidopsis* (Riechmann, J. L., et al., (2000) Science 290:2105-10), and at least nine in rice and thirteen in maize.

PHD-zf domains contain a C4HC3 zinc-finger-like motif found in nuclear proteins thought to be involved in chromatin-mediated transcriptional regulation, and more specifically bind DNA at a core hexamer motif of either GNGGTG or GTGGNG (Bastola, et al., 1998). Within this PHD-zf domain, is a highly conserved Trp residue. PHD-zf polypeptides also contain an acidic region characteristic of DNA-binding proteins that interact with other proteins.

Winicov and Bastola overexpressed Alfin-1 using the constitutive 35S promoter and showed that the transgenic alfalfa plants grew normally with no striking phenotype except that the leaves were somewhat broader than those from the untransformed plant (Winicov & Bastola (1999) Plant Physiol 120:473-480). In contrast, transgenic plants overexpressing Alfin-1 in the antisense orientation grew more poorly in soil suggesting that Alfin-1 is essential for normal plant growth. It was shown that constitutive expression by the 35S promoter of Alfin-1 does increases salt tolerance of transgenic plants (Winicov & Bastola (1999) supra). Further characterization of these transgenic plants showed that root growth was enhanced, both in normal and salt-stressed soils (Winicov (2000) Planta 210:416-22). Winicov reported mild enhancements in the shoot weight of the transgenic alfalfa plants.

In international patent application WO99/53016, are described nucleic acid sequences encoding PHD-zf polypeptides, and constructs comprising these. Transgenic plants overexpressing a PHD-zf (Alfin-1) with increased salinity tolerance relative to control plants are shown. These plants are further characterized by enhanced root growth in normal and saline soils.

Surprisingly, it has now been found that increasing expression in a plant of a nucleic acid sequence encoding a PHD-zf polypeptide as defined herein, gives plants having increased seed yield-related traits relative to control plants.

According to one embodiment, there is provided a method for increasing seed yield-related traits in plants relative to control plants, comprising increasing expression in a plant of a nucleic acid sequence encoding a PHD-zf polypeptide as defined herein. The increased seed yield-related traits comprise one or more of: increased plant height, increased seed fill rate, increased number of flowers per panicles, and increased Thousand Kernel Weight (TKW).

5. REF/ALY Polypeptides

Protein biosynthesis in living cells occurs via a multi-step process involving gene transcription into messenger RNA (mRNA) and subsequent translation of such mRNA into a protein. In Eukaryots gene expression requires export of the mRNAs from their site of transcription in the nucleus to the cytoplasm where they are translated. There are hundreds of genes controlling gene expression and only a few of them have been shown to have a beneficial effect on traits of interest to agriculture industry, when its expression is modulated in the plant (Vinocur and Altman, 2005, Current Opinion in Biotechnology 16, 123-132; Gutterson and Reuber 2004. Current Opinion in Plant Biology, 7, 465-471).

of In particular the REF/ALY proteins have been involved in transcriptional coactivation and in mRNA nuclear export transport. The REF/ALY proteins are conserved across kingdoms. The yeast genome encodes a single REF/ALY protein while higher eukaryotes contain a small family of genes encoding REF/ALY proteins. ALY proteins are approximately 30-kD proteins and have a highly conserved domain structure. This consists of short N-terminal and C-terminal motifs flanking two variable regions containing varying numbers Arg-Gly-Gly (RGG) repeats embedded in non-conserved aminoacid sequence. The central domain of the protein contains an RNA-binding domain (also referred to as an RNA-recognition motif [RRM]) that contains two more highly conserved subdomains, RNP1 and RNP2.

In *Arabidopsis thaliana*, two of the four members of the REF/ALY protein family have been characterized by their ability to bind to the PARP (Poly-ADP-Ribose polymerase), a protein involved the control of genome integrity, chromatin structure, DNA repair and cell death (Storozhenko et at. 2001. J. Exp. Bot. 52, 1375-1380). Furthermore, another member of the family reportedly interacts with the P19 protein of Tomato Bushy Stunt Virus (Uhrig et al. 2004, Plant Physiology Vol. 135, pp. 2411-2423).

Surprisingly, it has now been found that modulating expression of a nucleic acid encoding a REF/ALY polypeptide gives plants having enhanced yield-related traits.

According one embodiment, there is provided a method for enhancing yield related traits of a plant relative to control plants, comprising modulating expression of a nucleic acid encoding a REF/ALY polypeptide in a plant.

DEFINITIONS

Polypeptide(s)/Protein(s)

The terms "polypeptide" and "protein" are used interchangeably herein and refer to amino acids in a polymeric form of any length, linked together by peptide bonds.

Polynucleotide(s)/Nucleic Acid(s)/Nucleic Acid Sequence(s)/Nucleotide Sequence(s)

The terms "polynucleotide(s)", "nucleic acid sequence(s)", "nucleotide sequence(s)", "nucleic acid(s)", "nucleic acid molecule" are used interchangeably herein and refer to nucleotides, either ribonucleotides or deoxyribonucleotides or a combination of both, in a polymeric unbranched form of any length.

Control Plant(s)

The choice of suitable control plants is a routine part of an experimental setup and may include corresponding wild type plants or corresponding plants without the gene of interest. The control plant is typically of the same plant species or even of the same variety as the plant to be assessed. The control plant may also be a nullizygote of the plant to be assessed. Nullizygotes are individuals missing the transgene by segregation. A "control plant" as used herein refers not only to whole plants, but also to plant parts, including seeds and seed parts.

Homologue(s)

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-6-tag, glutathione S-transferase-tag, protein A, maltose-binding protein, dihydrofolate reductase, Tag•100 epitope, c-myc epitope, FLAG®-epitope, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break α-helical structures or β-sheet structures). Amino acid substitutions are typically of single residues, but may be clustered depending upon functional constraints placed upon the polypeptide; insertions will usually be of the order of about 1 to 10 amino acid residues. The amino acid substitutions are preferably conservative amino acid substitutions. Conservative substitution tables are well known in the art (see for example Creighton (1984) Proteins. W.H. Freeman and Company (Eds) and Table 1 below).

TABLE 1

Examples of conserved amino acid substitutions

| Residue | Conservative Substitutions |
|---|---|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

Amino acid substitutions, deletions and/or insertions may readily be made using peptide synthetic techniques well known in the art, such as solid phase peptide synthesis and the like, or by recombinant DNA manipulation. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, Ohio), QuickChange Site Directed mutagenesis (Stratagene, San Diego, Calif.), PCR-mediated site-directed mutagenesis or other site-directed mutagenesis protocols.

Derivatives

"Derivatives" include peptides, oligopeptides, polypeptides which may, compared to the amino acid sequence of the naturally-occurring form of the protein, such as the protein of interest, comprise substitutions of amino acids with non-naturally occurring amino acid residues, or additions of non-naturally occurring amino acid residues. "Derivatives" of a protein also encompass peptides, oligopeptides, polypeptides which comprise naturally occurring altered (glycosylated, acylated, prenylated, phosphorylated, myristoylated, sulphated etc.) or non-naturally altered amino acid residues compared to the amino acid sequence of a naturally-occurring form of the polypeptide. A derivative may also comprise one or more non-amino acid substituents or additions compared to the amino acid sequence from which it is derived, for example a reporter molecule or other ligand, covalently or non-covalently bound to the amino acid sequence, such as a reporter molecule which is bound to facilitate its detection, and non-naturally occurring amino acid residues relative to the amino acid sequence of a naturally-occurring protein. Furthermore, "derivatives" also include fusions of the naturally-occurring form of the protein with tagging peptides such as FLAG, HIS6 or thioredoxin (for a review of tagging peptides, see Terpe, Appl. Microbiol. Biotechnol. 60, 523-533, 2003).

Orthologue(s)/Paralogue(s)

Orthologues and paralogues encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene.

Domain

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

Motif/Consensus Sequence/Signature

The term "motif" or "consensus sequence" or "signature" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain).

Hybridisation

The term "hybridisation" as defined herein is a process wherein substantially homologous complementary nucleotide sequences anneal to each other. The hybridisation process can occur entirely in solution, i.e. both complementary nucleic acids are in solution. The hybridisation process can also occur with one of the complementary nucleic acids immobilised to a matrix such as magnetic beads, Sepharose beads or any other resin. The hybridisation process can furthermore occur with one of the complementary nucleic acids immobilised to a solid support such as a nitro-cellulose or nylon membrane or immobilised by e.g. photolithography to, for example, a siliceous glass support (the latter known as nucleic acid arrays or microarrays or as nucleic acid chips). In order to allow hybridisation to occur, the nucleic acid molecules are generally thermally or chemically denatured to melt a double strand into two single strands and/or to remove hairpins or other secondary structures from single stranded nucleic acids.

The term "stringency" refers to the conditions under which a hybridisation takes place. The stringency of hybridisation is influenced by conditions such as temperature, salt concentration, ionic strength and hybridisation buffer composition. Generally, low stringency conditions are selected to be about 30° C. lower than the thermal melting point ($T_m$) for the specific sequence at a defined ionic strength and pH. Medium stringency conditions are when the temperature is 20° C. below $T_m$, and high stringency conditions are when the temperature is 10° C. below $T_m$. High stringency hybridisation conditions are typically used for isolating hybridising sequences that have high sequence similarity to the target nucleic acid sequence. However, nucleic acids may deviate in sequence and still encode a substantially identical polypeptide, due to the degeneracy of the genetic code. Therefore medium stringency hybridisation conditions may sometimes be needed to identify such nucleic acid molecules.

The Tm is the temperature under defined ionic strength and pH, at which 50% of the target sequence hybridises to a perfectly matched probe. The $T_m$ is dependent upon the solution conditions and the base composition and length of the probe. For example, longer sequences hybridise specifically at higher temperatures. The maximum rate of hybridisation is obtained from about 16° C. up to 32° C. below $T_m$. The presence of monovalent cations in the hybridisation solution reduce the electrostatic repulsion between the two nucleic acid strands thereby promoting hybrid formation; this effect is visible for sodium concentrations of up to 0.4M (for higher concentrations, this effect may be ignored). Formamide reduces the melting temperature of DNA-DNA and DNA-RNA duplexes with 0.6 to 0.7° C. for each percent formamide, and addition of 50% formamide allows hybridisation to be performed at 30 to 45° C., though the rate of hybridisation will be lowered. Base pair mismatches reduce the hybridisation rate and the thermal stability of the duplexes. On average and for large probes, the Tm decreases about 1° C. per % base mismatch. The Tm may be calculated using the following equations, depending on the types of hybrids:

1) DNA-DNA hybrids (Meinkoth and Wahl, Anal. Biochem., 138: 267-284, 1984):

$$T_m = 81.5° C. + 16.6x \log_{10}[Na^+]^a + 0.41x \%[G/C^b] - 500x [L^c]^{-1} - 0.61x \% \text{ formamide}$$

2) DNA-RNA or RNA-RNA hybrids:

$$Tm = 79.8 + 18.5(\log_{10}[Na^+]^a) + 0.58(\% G/C^b) + 11.8(\% G/C^b)^2 - 820/L^c$$

3) oligo-DNA or oligo-RNA$^d$ hybrids:

For <20 nucleotides: $T_m = 2(l_n)$

For 20-35 nucleotides: $T_m = 22 + 1.46(l_n)$ $^a$ or for other monovalent cation, but only accurate in the 0.01-0.4 M range.

$^b$ only accurate for % GC in the 30% to 75% range.

$^c$ L=length of duplex in base pairs.
$^d$ oligo, oligonucleotide; $l_n$=effective length of primer=2×(no. of G/C)+(no. of A/T).

Non-specific binding may be controlled using any one of a number of known techniques such as, for example, blocking the membrane with protein containing solutions, additions of heterologous RNA, DNA, and SDS to the hybridisation buffer, and treatment with Rnase. For non-homologous probes, a series of hybridizations may be performed by varying one of (i) progressively lowering the annealing temperature (for example from 68° C. to 42° C.) or (ii) progressively lowering the formamide concentration (for example from 50% to 0%). The skilled artisan is aware of various parameters which may be altered during hybridisation and which will either maintain or change the stringency conditions.

Besides the hybridisation conditions, specificity of hybridisation typically also depends on the function of post-hybridisation washes. To remove background resulting from non-specific hybridisation, samples are washed with dilute salt solutions. Critical factors of such washes include the ionic strength and temperature of the final wash solution: the lower the salt concentration and the higher the wash temperature, the higher the stringency of the wash. Wash conditions are typically performed at or below hybridisation stringency. A positive hybridisation gives a signal that is at least twice of that of the background. Generally, suitable stringent conditions for nucleic acid hybridisation assays or gene amplification detection procedures are as set forth above. More or less stringent conditions may also be selected. The skilled artisan is aware of various parameters which may be altered during washing and which will either maintain or change the stringency conditions.

For example, typical high stringency hybridisation conditions for DNA hybrids longer than 50 nucleotides encompass hybridisation at 65° C. in 1×SSC or at 42° C. in 1×SSC and 50% formamide, followed by washing at 65° C. in 0.3×SSC. Examples of medium stringency hybridisation conditions for DNA hybrids longer than 50 nucleotides encompass hybridisation at 50° C. in 4×SSC or at 40° C. in 6×SSC and 50% formamide, followed by washing at 50° C. in 2×SSC. The length of the hybrid is the anticipated length for the hybridising nucleic acid. When nucleic acids of known sequence are hybridised, the hybrid length may be determined by aligning the sequences and identifying the conserved regions described herein. 1×SSC is 0.15M NaCl and 15 mM sodium citrate; the hybridisation solution and wash solutions may additionally include 5× Denhardt's reagent, 0.5-1.0% SDS, 100 µg/ml denatured, fragmented salmon sperm DNA, 0.5% sodium pyrophosphate.

For the purposes of defining the level of stringency, reference can be made to Sambrook et al. (2001) Molecular Cloning: a laboratory manual, 3$^{rd}$ Edition, Cold Spring Harbor Laboratory Press, CSH, New York or to Current Protocols in Molecular Biology, John Wiley & Sons, N.Y. (1989 and yearly updates).

Splice Variant

The term "splice variant" as used herein encompasses variants of a nucleic acid sequence in which selected introns and/or exons have been excised, replaced, displaced or added, or in which introns have been shortened or lengthened. Such variants will be ones in which the biological activity of the protein is substantially retained; this may be achieved by selectively retaining functional segments of the protein. Such splice variants may be found in nature or may be manmade. Methods for predicting and isolating such splice variants are well known in the art (see for example Foissac and Schiex (2005) BMC Bioinformatics 6: 25).

Allelic Variant

Alleles or allelic variants are alternative forms of a given gene, located at the same chromosomal position. Allelic variants encompass Single Nucleotide Polymorphisms (SNPs), as well as Small Insertion/Deletion Polymorphisms (IN-DELs). The size of INDELs is usually less than 100 bp. SNPs and INDELs form the largest set of sequence variants in naturally occurring polymorphic strains of most organisms.

Gene Shuffling/Directed Evolution

Gene shuffling or directed evolution consists of iterations of DNA shuffling followed by appropriate screening and/or selection to generate variants of nucleic acids or portions thereof encoding proteins having a modified biological activity (Castle et al., (2004) Science 304(5674): 1151-4; U.S. Pat. Nos. 5,811,238 and 6,395,547).

Regulatory Element/Control Sequence/Promoter

The terms "regulatory element", "control sequence" and "promoter" are all used interchangeably herein and are to be taken in a broad context to refer to regulatory nucleic acid sequences capable of effecting expression of the sequences to which they are ligated. The term "promoter" typically refers to a nucleic acid control sequence located upstream from the transcriptional start of a gene and which is involved in recognising and binding of RNA polymerase and other proteins, thereby directing transcription of an operably linked nucleic acid. Encompassed by the aforementioned terms are transcriptional regulatory sequences derived from a classical eukaryotic genomic gene (including the TATA box which is required for accurate transcription initiation, with or without a CCAAT box sequence) and additional regulatory elements (i.e. upstream activating sequences, enhancers and silencers) which alter gene expression in response to developmental and/or external stimuli, or in a tissue-specific manner. Also included within the term is a transcriptional regulatory sequence of a classical prokaryotic gene, in which case it may include a −35 box sequence and/or −10 box transcriptional regulatory sequences. The term "regulatory element" also encompasses a synthetic fusion molecule or derivative that confers, activates or enhances expression of a nucleic acid molecule in a cell, tissue or organ.

A "plant promoter" comprises regulatory elements, which mediate the expression of a coding sequence segment in plant cells. Accordingly, a plant promoter need not be of plant origin, but may originate from viruses or micro-organisms, for example from viruses which attack plant cells. The "plant promoter" can also originate from a plant cell, e.g. from the plant which is transformed with the nucleic acid sequence to be expressed in the inventive process and described herein. This also applies to other "plant" regulatory signals, such as "plant" terminators. The promoters upstream of the nucleotide sequences useful in the methods of the present invention can be modified by one or more nucleotide substitution(s), insertion(s) and/or deletion(s) without interfering with the functionality or activity of either the promoters, the open reading frame (ORF) or the 3'-regulatory region such as terminators or other 3' regulatory regions which are located away from the ORF. It is furthermore possible that the activity of the promoters is increased by modification of their sequence, or that they are replaced completely by more active promoters, even promoters from heterologous organisms. For expression in plants, the nucleic acid molecule must, as described above, be linked operably to or comprise a suitable promoter which expresses the gene at the right point in time and with the required spatial expression pattern.

For the identification of functionally equivalent promoters, the promoter strength and/or expression pattern of a candidate promoter may be analysed for example by operably linking the promoter to a reporter gene and assaying the expression level and pattern of the reporter gene in various tissues of the plant. Suitable well-known reporter genes include for example beta-glucuronidase or beta-galactosidase. The promoter activity is assayed by measuring the enzymatic activity of the beta-glucuronidase or beta-galactosidase. The promoter strength and/or expression pattern may then be compared to that of a reference promoter (such as the one used in the methods of the present invention). Alternatively, promoter strength may be assayed by quantifying mRNA levels or by comparing mRNA levels of the nucleic acid used in the methods of the present invention, with mRNA levels of housekeeping genes such as 18S rRNA, using methods known in the art, such as Northern blotting with densitometric analysis of autoradiograms, quantitative real-time PCR or RT-PCR (Heid et al., 1996 Genome Methods 6: 986-994). Generally by "weak promoter" is intended a promoter that drives expression of a coding sequence at a low level. By "low level" is intended at levels of about 1/10,000 transcripts to about 1/100,000 transcripts, to about 1/500, 0000 transcripts per cell. Conversely, a "strong promoter" drives expression of a coding sequence at high level, or at about 1/10 transcripts to about 1/100 transcripts to about 1/1000 transcripts per cell. Generally, by "medium strength promoter" is intended a promoter that drives expression of a coding sequence at a lower level than a strong promoter, in particular at a level that is in all instances below that obtained when under the control of a 35S CaMV promoter.

Operably Linked

The term "operably linked" as used herein refers to a functional linkage between the promoter sequence and the gene of interest, such that the promoter sequence is able to initiate transcription of the gene of interest.

Constitutive Promoter

A "constitutive promoter" refers to a promoter that is transcriptionally active during most, but not necessarily all, phases of growth and development and under most environmental conditions, in at least one cell, tissue or organ. Table 2a below gives examples of constitutive promoters.

TABLE 2a

Examples of constitutive promoters

| Gene Source | Reference |
|---|---|
| Actin | McElroy et al, Plant Cell, 2: 163-171, 1990 |
| HMGP | WO 2004/070039 |
| CAMV 35S | Odell et al, Nature, 313: 810-812, 1985 |
| CaMV 19S | Nilsson et al., Physiol. Plant. 100: 456-462, 1997 |
| GOS2 | de Pater et al, Plant J November; 2(6): 837-44, 1992, WO 2004/065596 |
| Ubiquitin | Christensen et al, Plant Mol. Biol. 18: 675-689, 1992 |
| Rice cyclophilin | Buchholz et al, Plant Mol Biol. 25(5): 837-43, 1994 |
| Maize H3 histone | Lepetit et al, Mol. Gen. Genet. 231: 276-285, 1992 |
| Alfalfa H3 histone | Wu et al. Plant Mol. Biol. 11: 641-649, 1988 |
| Actin 2 | An et al, Plant J. 10(1); 107-121, 1996 |
| 34S FMV | Sanger et al., Plant. Mol. Biol., 14, 1990: 433-443 |
| Rubisco small subunit | U.S. Pat. No. 4,962,028 |
| OCS | Leisner (1988) Proc Natl Acad Sci USA 85(5): 2553 |
| SAD1 | Jain et al., Crop Science, 39 (6), 1999: 1696 |
| SAD2 | Jain et al., Crop Science, 39 (6), 1999: 1696 |
| nos | Shaw et al. (1984) Nucleic Acids Res. 12(20): 7831-7846 |
| V-ATPase | WO 01/14572 |
| Super promoter | WO 95/14098 |
| G-box proteins | WO 94/12015 |

Ubiquitous Promoter

A ubiquitous promoter is active in substantially all tissues or cells of an organism.

Developmentally-Regulated Promoter

A developmentally-regulated promoter is active during certain developmental stages or in parts of the plant that undergo developmental changes.

Inducible Promoter

An inducible promoter has induced or increased transcription initiation in response to a chemical (for a review see Gatz 1997, Annu. Rev. Plant Physiol. Plant Mol. Biol., 48:89-108), environmental or physical stimulus, or may be "stress-inducible", i.e. activated when a plant is exposed to various stress conditions, or a "pathogen-inducible" i.e. activated when a plant is exposed to exposure to various pathogens.

Organ-Specific/Tissue-Specific Promoter

An organ-specific or tissue-specific promoter is one that is capable of preferentially initiating transcription in certain organs or tissues, such as the leaves, roots, seed tissue etc. For example, a "root-specific promoter" is a promoter that is transcriptionally active predominantly in plant roots, substantially to the exclusion of any other parts of a plant, whilst still allowing for any leaky expression in these other plant parts. Promoters able to initiate transcription in certain cells only are referred to herein as "cell-specific".

Examples of root-specific promoters are listed in Table 2b below:

TABLE 2b

Examples of root-specific promoters

| Gene Source | Reference |
|---|---|
| RCc3 | Plant Mol Biol. 1995 January; 27(2):237-48 |
| Arabidopsis PHT1 | Kovama et al., 2005; Mudge et al. (2002, Plant J. 31: 341) |
| Medicago phosphate transporter | Xiao et al., 2006 |
| Arabidopsis Pyk10 | Nitz et al. (2001) Plant Sci 161(2): 337-346 |
| root-expressible genes | Tingey et al., EMBO J. 6: 1, 1987. |
| tobacco auxin-inducible gene | Van der Zaal et al., Plant Mol. Biol. 16, 983, 1991. |
| β-tubulin | Oppenheimer, et al., Gene 63: 87, 1988. |
| tobacco root-specific genes | Conkling, et al., Plant Physiol. 93: 1203, 1990. |
| B. napus G1-3b gene | U.S. Pat. No. 5,401,836 |
| SbPRP1 | Suzuki et al., Plant. Mol. Biol. 21: 109-119, 1993. |
| LRX1 | Baumberger et al. 2001, Genes & Dev. 15: 1128 |
| BTG-26 Brassica napus | U.S. 20050044585 |
| LeAMT1 (tomato) | Lauter et al. (1996, PNAS 3:8139) |
| The LeNRT1-1 (tomato) | Lauter et al. (1996, PNAS 3:8139) |
| class I patatin gene (potato) | Liu et al., Plant Mol. Biol. 153:386-395, 1991. |
| KDC1 (Daucus carota) | Downey et al. (2000, J. Biol. Chem. 275: 39420) |
| TobRB7 gene | W Song (1997) PhD Thesis, North Carolina State University, Raleigh, NC USA |
| OsRAB5a (rice) | Wang et al. 2002, Plant Sci. 163:273 |
| ALF5 (Arabidopsis) | Diener et al. (2001, Plant Cell 13:1625) |
| NRT2; 1Np (N. plumbaginifolia) | Quesada et al. (1997, Plant Mol. Biol. 34:265) |

A seed-specific promoter is transcriptionally active predominantly in seed tissue, but not necessarily exclusively in seed tissue (in cases of leaky expression). The seed-specific promoter may be active during seed development and/or during germination. The seed specific promoter may be endosperm/aleurone/embryo specific. Examples of seed-specific promoters (endosperm/aleurone/embryo specific) are shown in Table 2c to Table 2f below. Further examples of seed-specific promoters are given in Qing Qu and Takaiwa (Plant Biotechnol. J. 2, 113-125, 2004), which disclosure is incorporated by reference herein as if fully set forth.

TABLE 2c

Examples of seed-specific promoters

| Gene source | Reference |
|---|---|
| seed-specific genes | Simon et al., Plant Mol. Biol. 5: 191, 1985; Scofield et al., J. Biol. Chem. 262: 12202, 1987.; Baszczynski et al., Plant Mol. Biol. 14: 633, 1990. |
| Brazil Nut albumin | Pearson et al., Plant Mol. Biol. 18: 235-245, 1992. |
| legumin | Ellis et al., Plant Mol. Biol. 10: 203-214, 1988. |
| glutelin (rice) | Takaiwa et al., Mol. Gen. Genet. 208: 15-22, 1986; Takaiwa et al., FEBS Letts. 221: 43-47, 1987. |
| zein | Matzke et al Plant Mol Biol, 14(3): 323-32 1990 |
| napA | Stalberg et al, Planta 199: 515-519, 1996. |
| wheat LMW and HMW glutenin-1 | Mol Gen Genet 216: 81-90, 1989; NAR 17: 461-2, 1989 |
| wheat SPA | Albani et al, Plant Cell, 9: 171-184, 1997 |
| wheat α, β, γ-gliadins | EMBO J. 3: 1409-15, 1984 |
| barley Itr1 promoter | Diaz et al. (1995) Mol Gen Genet 248(5): 592-8 |
| barley B1, C, D, hordein | Theor Appl Gen 98: 1253-62, 1999; Plant J 4: 343-55, 1993; Mol Gen Genet 250: 750-60, 1996 |
| barley DOF | Mena et al, The Plant Journal, 116(1): 53-62, 1998 |
| blz2 | EP99106056.7 |
| synthetic promoter | Vicente-Carbajosa et al., Plant J. 13: 629-640, 1998. |
| rice prolamin NRP33 | Wu et al, Plant Cell Physiology 39(8) 885-889, 1998 |
| rice a-globulin Glb-1 | Wu et al, Plant Cell Physiology 39(8) 885-889, 1998 |
| rice OSH1 | Sato et al, Proc. Natl. Acad. Sci. USA, 93: 8117-8122, 1996 |
| rice α-globulin REB/OHP-1 | Nakase et al. Plant Mol. Biol. 33: 513-522, 1997 |
| rice ADP-glucose pyrophosphorylase | Trans Res 6:157-68, 1997 |
| maize ESR gene family | Plant J 12:235-46, 1997 |
| sorghum α-kafirin | DeRose et al., Plant Mol. Biol 32: 1029-35, 1996 |
| KNOX | Postma-Haarsma et al, Plant Mol. Biol. 39: 257-71, 1999 |
| rice oleosin | Wu et al, J. Biochem. 123: 386, 1998 |
| sunflower oleosin | Cummins et al., Plant Mol. Biol. 19: 873-876, 1992 |
| PRO0117, putative rice 40S ribosomal protein | WO 2004/070039 |
| PRO0136, rice alanine aminotransferase | unpublished |
| PRO0147, trypsin inhibitor ITR1 (barley) | unpublished |
| PRO0151, rice WSI18 | WO 2004/070039 |
| PRO0175, rice RAB21 | WO 2004/070039 |
| PRO005 | WO 2004/070039 |
| PRO0095 | WO 2004/070039 |
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38,1998 |

TABLE 2d examples of endosperm-specific promoters

| Gene source | Reference |
|---|---|
| glutelin (rice) | Takaiwa et al. (1986) Mol Gen Genet 208: 15-22; Takaiwa et al. (1987) FEBS Letts. 221: 43-47 |
| zein | Matzke et al., (1990) Plant Mol Biol 14(3): 323-32 |
| wheat LMW and | Colot et al. (1989) Mol Gen Genet 216: 81-90, |

TABLE 2d-continued examples of endosperm-specific promoters

| Gene source | Reference |
|---|---|
| HMW glutenin-1 | Anderson et al. (1989) NAR 17: 4 61-2 |
| wheat SPA | Albani et al. (1997) Plant Cell 9: 171-184 |
| wheat gliadins | Rafalski et al. (1984) EMBO 3: 1409-15 |
| barley Itr1 promoter | Diaz et al. (1995) Mol Gen Genet 248(5): 592-8 |
| barley B1, C, D, hordein | Cho et al. (1999) Theor Appl Genet 98: 1253-62; Muller et al. (1993) Plant J 4: 343-55; Sorenson et al. (1996) Mol Gen Genet 250: 750-60 |
| barley DOF | Mena et al, (1998) Plant J 116(1): 53-62 |
| blz2 | Onate et al. (1999) J Biol Chem 274(14): 9175-82 |
| synthetic promoter | Vicente-Carbajosa et al. (1998) Plant J 13: 629-640 |
| rice prolamin NRP33 | Wu et al, (1998) Plant Cell Physiol 39(8) 885-889 |
| rice globulin Glb-1 | Wu et al. (1998) Plant Cell Physiol 39(8) 885-889 |
| rice globulin REB/OHP-1 | Nakase et al. (1997) Plant Molec Biol 33: 513-522 |
| rice ADP-glucose pyrophosphorylase | Russell et al. (1997) Trans Res 6: 157-68 |
| maize ESR gene family | Opsahl-Ferstad et al. (1997) Plant J 12: 235-46 |
| sorghum kafirin | DeRose et al. (1996) Plant Mol Biol 32: 1029-35 |

TABLE 2e

Examples of embryo specific promoters:

| Gene source | Reference |
|---|---|
| rice OSH1 | Sato et al, Proc. Natl. Acad. Sci. USA, 93: 8117-8122, 1996 |
| KNOX | Postma-Haarsma et al, Plant Mol. Biol. 39: 257-71, 1999 |
| PRO0151 | WO 2004/070039 |
| PRO0175 | WO 2004/070039 |
| PRO005 | WO 2004/070039 |
| PRO0095 | WO 2004/070039 |

TABLE 2f

Examples of aleurone-specific promoters:

| Gene source | Reference |
|---|---|
| α-amylase (Amy32b) | Lanahan et al, Plant Cell 4:203-211, 1992; Skriver et al, Proc Natl Aced Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

A green tissue-specific promoter as defined herein is a promoter that is transcriptionally active predominantly in green tissue, substantially to the exclusion of any other parts of a plant, whilst still allowing for any leaky expression in these other plant parts.

Examples of green tissue-specific promoters which may be used to perform the methods of the invention are shown in Table 2g below.

TABLE 2g

Examples of green tissue-specific promoters

| Gene | Expression | Reference |
|---|---|---|
| Maize Orthophosphate dikinase | Leaf specific | Fukavama et al., 2001 |
| Maize Phosphoenolpyruvate carboxylase | Leaf specific | Kausch et al., 2001 |
| Rice Phosphoenolpyruvate carboxylase | Leaf specific | Liu et al., 2003 |

TABLE 2g-continued

Examples of green tissue-specific promoters

| Gene | Expression | Reference |
|---|---|---|
| Rice small subunit Rubisco | Leaf specific | Nomura et al., 2000 |
| rice beta expansin EXBP9 | Shoot specific | WO 2004/070039 |
| Pigeonpea small subunit Rubisco | Leaf specific | Panguluri et al., 2005 |
| Pea RBCS3A | Leaf specific | |

Another example of a tissue-specific promoter is a meristem-specific promoter, which is transcriptionally active predominantly in meristematic tissue, substantially to the exclusion of any other parts of a plant, whilst still allowing for any leaky expression in these other plant parts. Examples of green meristem-specific promoters which may be used to perform the methods of the invention are shown in Table 2h below.

TABLE 2h

Examples of meristem-specific promoters

| Gene source | Expression pattern | Reference |
|---|---|---|
| rice OSH1 | Shoot apical meristem, from embryo globular stage to seedling stage | Sato et al. (1996) Proc. Natl. Acad. Sci. USA, 93: 8117-8122 |
| Rice metallothionein | Meristem specific | BAD87835.1 |
| WAK1 & WAK 2 | Shoot and root apical meristems, and in expanding leaves and sepals | Wagner & Kohorn (2001) Plant Cell 13(2): 303-318 |

Terminator

The term "terminator" encompasses a control sequence which is a DNA sequence at the end of a transcriptional unit which signals 3' processing and polyadenylation of a primary transcript and termination of transcription. The terminator can be derived from the natural gene, from a variety of other plant genes, or from T-DNA. The terminator to be added may be derived from, for example, the nopaline synthase or octopine synthase genes, or alternatively from another plant gene, or less preferably from any other eukaryotic gene.

Modulation

The term "modulation" means in relation to expression or gene expression, a process in which the expression level is changed by said gene expression in comparison to the control plant, the expression level may be increased or decreased. The original, unmodulated expression may be of any kind of expression of a structural RNA (rRNA, tRNA) or mRNA with subsequent translation. The term "modulating the activity" shall mean any change of the expression of the inventive nucleic acid sequences or encoded proteins, which leads to increased yield and/or increased growth of the plants.

Expression

The term "expression" or "gene expression" means the transcription of a specific gene or specific genes or specific genetic construct. The term "expression" or "gene expression" in particular means the transcription of a gene or genes or genetic construct into structural RNA (rRNA, tRNA) or mRNA with or without subsequent translation of the latter into a protein. The process includes transcription of DNA and processing of the resulting mRNA product.

Increased Expression/Overexpression

The term "increased expression" or "overexpression" as used herein means any form of expression that is additional to the original wild-type expression level.

Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a nucleic acid encoding the polypeptide of interest. For example, endogenous promoters may be altered in vivo by mutation, deletion, and/or substitution (see, Kmiec, U.S. Pat. No. 5,565,350; Zarling et al., WO9322443), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region (UTR) or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. For general information see: The Maize Handbook, Chapter 116, Freeling and Walbot, Eds., Springer, N.Y. (1994).

Endogenous Gene

Reference herein to an "endogenous" gene not only refers to the gene in question as found in a plant in its natural form (i.e., without there being any human intervention), but also refers to that same gene (or a substantially homologous nucleic acid/gene) in an isolated form subsequently (re)introduced into a plant (a transgene). For example, a transgenic plant containing such a transgene may encounter a substantial reduction of the transgene expression and/or substantial reduction of expression of the endogenous gene. The isolated gene may be isolated from an organism or may be manmade, for example by chemical synthesis.

Decreased Expression

Reference herein to "decreased expression" or "reduction or substantial elimination" of expression is taken to mean a decrease in endogenous gene expression and/or polypeptide levels and/or polypeptide activity relative to control plants. The reduction or substantial elimination is in increasing order of preference at least 10%, 20%, 30%, 40% or 50%, 60%, 70%, 80%, 85%, 90%, or 95%, 96%, 97%, 98%, 99% or more reduced compared to that of control plants. Methods for decreasing expression are known in the art and the skilled person would readily be able to adapt the known methods for silencing so as to achieve reduction of expression of an endogenous gene in a whole plant or in parts thereof through the use of an appropriate promoter, for example.

For the reduction or substantial elimination of expression an endogenous gene in a plant, a sufficient length of substantially contiguous nucleotides of a nucleic acid sequence is required. In order to perform gene silencing, this may be as little as 20, 19, 18, 17, 16, 15, 14, 13, 12, 11, 10 or fewer nucleotides, alternatively this may be as much as the entire gene (including the 5' and/or 3' UTR, either in part or in whole). The stretch of substantially contiguous nucleotides may be derived from the nucleic acid encoding the protein of interest (target gene), or from any nucleic acid capable of encoding an orthologue, paralogue or homologue of the protein of interest. Preferably, the stretch of substantially contiguous nucleotides is capable of forming hydrogen bonds with the target gene (either sense or antisense strand), more preferably, the stretch of substantially contiguous nucleotides has, in increasing order of preference, 50%, 60%, 70%, 80%, 85%, 90%, 95%, 96%, 97%, 98%, 99%, 100% sequence identity to the target gene (either sense or antisense strand). A nucleic acid sequence encoding a (functional) polypeptide is not a requirement for the various methods discussed herein for the reduction or substantial elimination of expression of an endogenous gene.

Examples of various methods for the reduction or substantial elimination of expression in a plant of an endogenous gene, or for lowering levels and/or activity of a protein, are known to the skilled in the art. A skilled person would readily be able to adapt the known methods for silencing, so as to achieve reduction of expression of an endogenous gene in a whole plant or in parts thereof through the use of an appropriate promoter, for example.

This reduction or substantial elimination of expression may be achieved using routine tools and techniques. A preferred method for the reduction or substantial elimination of endogenous gene expression is by introducing and expressing in a plant a genetic construct into which the nucleic acid (in this case a stretch of substantially contiguous nucleotides derived from the gene of interest, or from any nucleic acid capable of encoding an orthologue, paralogue or homologue of any one of the protein of interest) is cloned as an inverted repeat (in part or completely), separated by a spacer (non-coding DNA).

In such a preferred method, expression of the endogenous gene is reduced or substantially eliminated through RNA-mediated silencing using an inverted repeat of a nucleic acid or a part thereof (in this case a stretch of substantially contiguous nucleotides derived from the gene of interest, or from any nucleic acid capable of encoding an orthologue, paralogue or homologue of the protein of interest), preferably capable of forming a hairpin structure. The inverted repeat is cloned in an expression vector comprising control sequences. A non-coding DNA nucleic acid sequence (a spacer, for example a matrix attachment region fragment (MAR), an intron, a polylinker, etc.) is located between the two inverted nucleic acids forming the inverted repeat. After transcription of the inverted repeat, a chimeric RNA with a self-complementary structure is formed (partial or complete). This double-stranded RNA structure is referred to as the hairpin RNA (hpRNA). The hpRNA is processed by the plant into siRNAs that are incorporated into an RNA-induced silencing complex (RISC). The RISC further cleaves the mRNA transcripts, thereby substantially reducing the number of mRNA transcripts to be translated into polypeptides. For further general details see for example, Grierson et al. (1998) WO 98/53083; Waterhouse et al. (1999) WO 99/53050.

Performance of the methods of the invention does not rely on introducing and expressing in a plant a genetic construct into which the nucleic acid is cloned as an inverted repeat, but any one or more of several well-known "gene silencing" methods may be used to achieve the same effects.

One such method for the reduction of endogenous gene expression is RNA-mediated silencing of gene expression (downregulation). Silencing in this case is triggered in a plant by a double stranded RNA sequence (dsRNA) that is substantially similar to the target endogenous gene. This dsRNA is further processed by the plant into about 20 to about 26 nucleotides called short interfering RNAs (siRNAs). The siRNAs are incorporated into an RNA-induced silencing complex (RISC) that cleaves the mRNA transcript of the endogenous target gene, thereby substantially reducing the number of mRNA transcripts to be translated into a polypeptide. Preferably, the double stranded RNA sequence corresponds to a target gene.

Another example of an RNA silencing method involves the introduction of nucleic acid sequences or parts thereof (in this case a stretch of substantially contiguous nucleotides derived from the gene of interest, or from any nucleic acid capable of encoding an orthologue, paralogue or homologue of the protein of interest) in a sense orientation into a plant. "Sense orientation" refers to a DNA sequence that is homologous to an mRNA transcript thereof. Introduced into a plant would therefore be at least one copy of the nucleic acid sequence. The additional nucleic acid sequence will reduce expression of the endogenous gene, giving rise to a phenomenon known as co-suppression. The reduction of gene expression will be more pronounced if several additional copies of a nucleic acid sequence are introduced into the plant, as there is a positive correlation between high transcript levels and the triggering of co-suppression.

Another example of an RNA silencing method involves the use of antisense nucleic acid sequences. An "antisense" nucleic acid sequence comprises a nucleotide sequence that is complementary to a "sense" nucleic acid sequence encoding a protein, i.e. complementary to the coding strand of a double-stranded cDNA molecule or complementary to an mRNA transcript sequence. The antisense nucleic acid sequence is preferably complementary to the endogenous gene to be silenced. The complementarity may be located in the "coding region" and/or in the "non-coding region" of a gene. The term "coding region" refers to a region of the nucleotide sequence comprising codons that are translated into amino acid residues. The term "non-coding region" refers to 5' and 3' sequences that flank the coding region that are transcribed but not translated into amino acids (also referred to as 5' and 3' untranslated regions).

Antisense nucleic acid sequences can be designed according to the rules of Watson and Crick base pairing. The antisense nucleic acid sequence may be complementary to the entire nucleic acid sequence (in this case a stretch of substantially contiguous nucleotides derived from the gene of interest, or from any nucleic acid capable of encoding an orthologue, paralogue or homologue of the protein of interest), but may also be an oligonucleotide that is antisense to only a part of the nucleic acid sequence (including the mRNA 5' and 3' UTR). For example, the antisense oligonucleotide sequence may be complementary to the region surrounding the translation start site of an mRNA transcript encoding a polypeptide. The length of a suitable antisense oligonucleotide sequence is known in the art and may start from about 50, 45, 40, 35, 30, 25, 20, 15 or 10 nucleotides in length or less. An antisense nucleic acid sequence according to the invention may be constructed using chemical synthesis and enzymatic ligation reactions using methods known in the art. For example, an antisense nucleic acid sequence (e.g., an antisense oligonucleotide sequence) may be chemically synthesized using naturally occurring nucleotides or variously modified nucleotides designed to increase the biological stability of the molecules or to increase the physical stability of the duplex formed between the antisense and sense nucleic acid sequences, e.g., phosphorothioate derivatives and acridine substituted nucleotides may be used. Examples of modified nucleotides that may be used to generate the antisense nucleic acid sequences are well known in the art. Known nucleotide modifications include methylation, cyclization and 'caps' and substitution of one or more of the naturally occurring nucleotides with an analogue such as inosine. Other modifications of nucleotides are well known in the art.

The antisense nucleic acid sequence can be produced biologically using an expression vector into which a nucleic acid sequence has been subcloned in an antisense orientation (i.e., RNA transcribed from the inserted nucleic acid will be of an antisense orientation to a target nucleic acid of interest). Preferably, production of antisense nucleic acid sequences in plants occurs by means of a stably integrated nucleic acid construct comprising a promoter, an operably linked antisense oligonucleotide, and a terminator.

The nucleic acid molecules used for silencing in the methods of the invention (whether introduced into a plant or generated in situ) hybridize with or bind to mRNA transcripts and/or genomic DNA encoding a polypeptide to thereby inhibit expression of the protein, e.g., by inhibiting transcription and/or translation. The hybridization can be by conventional nucleotide complementarity to form a stable duplex, or, for example, in the case of an antisense nucleic acid sequence which binds to DNA duplexes, through specific interactions in the major groove of the double helix. Antisense nucleic acid sequences may be introduced into a plant by transformation or direct injection at a specific tissue site. Alternatively, antisense nucleic acid sequences can be modified to target selected cells and then administered systemically. For example, for systemic administration, antisense nucleic acid sequences can be modified such that they specifically bind to receptors or antigens expressed on a selected cell surface, e.g., by linking the antisense nucleic acid sequence to peptides or antibodies which bind to cell surface receptors or antigens. The antisense nucleic acid sequences can also be delivered to cells using the vectors described herein.

According to a further aspect, the antisense nucleic acid sequence is an a-anomeric nucleic acid sequence. An a-anomeric nucleic acid sequence forms specific double-stranded hybrids with complementary RNA in which, contrary to the usual b-units, the strands run parallel to each other (Gaultier et al. (1987) Nucl Ac Res 15: 6625-6641). The antisense nucleic acid sequence may also comprise a 2'-o-methylribonucleotide (Inoue et al. (1987) Nucl Ac Res 15, 6131-6148) or a chimeric RNA-DNA analogue (Inoue et al. (1987) FEBS Lett. 215, 327-330).

The reduction or substantial elimination of endogenous gene expression may also be performed using ribozymes. Ribozymes are catalytic RNA molecules with ribonuclease activity that are capable of cleaving a single-stranded nucleic acid sequence, such as an mRNA, to which they have a complementary region. Thus, ribozymes (e.g., hammerhead ribozymes (described in Haselhoff and Gerlach (1988) Nature 334, 585-591) can be used to catalytically cleave mRNA transcripts encoding a polypeptide, thereby substantially reducing the number of mRNA transcripts to be translated into a polypeptide. A ribozyme having specificity for a nucleic acid sequence can be designed (see for example: Cech et al. U.S. Pat. No. 4,987,071; and Cech et al. U.S. Pat. No. 5,116,742). Alternatively, mRNA transcripts corresponding to a nucleic acid sequence can be used to select a catalytic RNA having a specific ribonuclease activity from a pool of RNA molecules (Bartel and Szostak (1993) Science 261, 1411-1418). The use of ribozymes for gene silencing in plants is known in the art (e.g., Atkins et al. (1994) WO 94/00012; Lenne et al. (1995) WO 95/03404; Lutziger et al. (2000) WO 00/00619; Prinsen et al. (1997) WO 97/13865 and Scott et al. (1997) WO 97/38116).

Gene silencing may also be achieved by insertion mutagenesis (for example, T-DNA insertion or transposon insertion) or by strategies as described by, among others, Angell and Baulcombe ((1999) Plant J 20(3): 357-62), (Amplicon VIGS WO 98/36083), or Baulcombe (WO 99/15682).

Gene silencing may also occur if there is a mutation on an endogenous gene and/or a mutation on an isolated gene/nucleic acid subsequently introduced into a plant. The reduction or substantial elimination may be caused by a non-functional polypeptide. For example, the polypeptide may bind to various interacting proteins; one or more mutation(s) and/or truncation(s) may therefore provide for a polypeptide that is still able to bind interacting proteins (such as receptor proteins) but that cannot exhibit its normal function (such as signalling ligand).

A further approach to gene silencing is by targeting nucleic acid sequences complementary to the regulatory region of the gene (e.g., the promoter and/or enhancers) to form triple helical structures that prevent transcription of the gene in target cells. See Helene, C., Anticancer Drug Res. 6, 569-84, 1991; Helene et al., Ann. N.Y. Acad. Sci. 660, 27-36 1992; and Maher, L. J. Bioassays 14, 807-15, 1992.

Other methods, such as the use of antibodies directed to an endogenous polypeptide for inhibiting its function in planta, or interference in the signalling pathway in which a polypeptide is involved, will be well known to the skilled man. In particular, it can be envisaged that manmade molecules may be useful for inhibiting the biological function of a target polypeptide, or for interfering with the signalling pathway in which the target polypeptide is involved.

Alternatively, a screening program may be set up to identify in a plant population natural variants of a gene, which variants encode polypeptides with reduced activity. Such natural variants may also be used for example, to perform homologous recombination.

Artificial and/or natural microRNAs (miRNAs) may be used to knock out gene expression and/or mRNA translation. Endogenous miRNAs are single stranded small RNAs of typically 19-24 nucleotides long. They function primarily to regulate gene expression and/or mRNA translation. Most plant microRNAs (miRNAs) have perfect or near-perfect complementarity with their target sequences. However, there are natural targets with up to five mismatches. They are processed from longer non-coding RNAs with characteristic fold-back structures by double-strand specific RNases of the Dicer family. Upon processing, they are incorporated in the RNA-induced silencing complex (RISC) by binding to its main component, an Argonaute protein. MiRNAs serve as the specificity components of RISC, since they base-pair to target nucleic acids, mostly mRNAs, in the cytoplasm. Subsequent regulatory events include target mRNA cleavage and destruction and/or translational inhibition. Effects of miRNA overexpression are thus often reflected in decreased mRNA levels of target genes.

Artificial microRNAs (amiRNAs), which are typically 21 nucleotides in length, can be genetically engineered specifically to negatively regulate gene expression of single or multiple genes of interest. Determinants of plant microRNA target selection are well known in the art. Empirical parameters for target recognition have been defined and can be used to aid in the design of specific amiRNAs, (Schwab et al., Dev. Cell 8, 517-527, 2005). Convenient tools for design and generation of amiRNAs and their precursors are also available to the public (Schwab et al., Plant Cell 18, 1121-1133, 2006).

For optimal performance, the gene silencing techniques used for reducing expression in a plant of an endogenous gene requires the use of nucleic acid sequences from monocotyledonous plants for transformation of monocotyledonous plants, and from dicotyledonous plants for transformation of dicotyledonous plants. Preferably, a nucleic acid sequence from any given plant species is introduced into that same species. For example, a nucleic acid sequence from rice is transformed into a rice plant. However, it is not an absolute requirement that the nucleic acid sequence to be introduced originates from the same plant species as the plant in which it will be introduced. It is sufficient that there is substantial homology between the endogenous target gene and the nucleic acid to be introduced.

Described above are examples of various methods for the reduction or substantial elimination of expression in a plant of an endogenous gene. A person skilled in the art would readily be able to adapt the aforementioned methods for silencing so as to achieve reduction of expression of an endogenous gene in a whole plant or in parts thereof through the use of an appropriate promoter, for example.

Selectable Marker (Gene)/Reporter Gene

"Selectable marker", "selectable marker gene" or "reporter gene" includes any gene that confers a phenotype on a cell in which it is expressed to facilitate the identification and/or selection of cells that are transfected or transformed with a nucleic acid construct of the invention. These marker genes enable the identification of a successful transfer of the nucleic acid molecules via a series of different principles. Suitable markers may be selected from markers that confer antibiotic or herbicide resistance, that introduce a new metabolic trait or that allow visual selection. Examples of selectable marker genes include genes conferring resistance to antibiotics (such as nptII that phosphorylates neomycin and kanamycin, or hpt, phosphorylating hygromycin, or genes conferring resistance to, for example, bleomycin, streptomycin, tetracyclin, chloramphenicol, ampicillin, gentamycin, geneticin (G418), spectinomycin or blasticidin), to herbicides (for example bar which provides resistance to Basta®; aroA or gox providing resistance against glyphosate, or the genes conferring resistance to, for example, imidazolinone, phosphinothricin or sulfonylurea), or genes that provide a metabolic trait (such as manA that allows plants to use mannose as sole carbon source or xylose isomerase for the utilisation of xylose, or antinutritive markers such as the resistance to 2-deoxyglucose). Expression of visual marker genes results in the formation of colour (for example β-glucuronidase, GUS or β-galactosidase with its coloured substrates, for example X-Gal), luminescence (such as the luciferin/luceferase system) or fluorescence (Green Fluorescent Protein, GFP, and derivatives thereof). This list represents only a small number of possible markers. The skilled worker is familiar with such markers. Different markers are preferred, depending on the organism and the selection method.

It is known that upon stable or transient integration of nucleic acids into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid can be identified for example by selection (for example, cells which have integrated the selectable marker survive whereas the other cells die). The marker genes may be removed or excised from the transgenic cell once they are no longer needed. Techniques for marker gene removal are known in the art, useful techniques are described above in the definitions section.

Since the marker genes, particularly genes for resistance to antibiotics and herbicides, are no longer required or are undesired in the transgenic host cell once the nucleic acids have been introduced successfully, the process according to the invention for introducing the nucleic acids advantageously employs techniques which enable the removal or excision of these marker genes. One such a method is what is known as co-transformation. The co-transformation method employs two vectors simultaneously for the transformation, one vector bearing the nucleic acid according to the invention and a second bearing the marker gene(s). A large proportion of transformants receives or, in the case of plants, comprises (up to 40% or more of the transformants), both vectors. In case of transformation with Agrobacteria, the transformants usually receive only a part of the vector, i.e. the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase source or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases the marker gene must be eliminated by performing crosses. In microbiology, techniques were developed which make possible, or facilitate, the detection of such events. A further advantageous method relies on what is known as recombination systems; whose advantage is that elimination by crossing can be dispensed with. The best-known system of this type is what is known as the Cre/lox system. Cre1 is a recombinase that removes the sequences located between the loxP sequences. If the marker gene is integrated between the loxP sequences, it is removed once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

Transgenic/Transgene/Recombinant

For the purposes of the invention, "transgenic", "transgene" or "recombinant" means with regard to, for example, a nucleic acid sequence, an expression cassette, gene construct or a vector comprising the nucleic acid sequence or an organism transformed with the nucleic acid sequences, expression cassettes or vectors according to the invention, all those constructions brought about by recombinant methods in which either (a) the nucleic acid sequences encoding proteins useful in the methods of the invention, or
(b) genetic control sequence(s) which is operably linked with the nucleic acid sequence according to the invention, for example a promoter, or
(c) a) and b)

are not located in their natural genetic environment or have been modified by recombinant methods, it being possible for the modification to take the form of, for example, a substitution, addition, deletion, inversion or insertion of one or more nucleotide residues. The natural genetic environment is understood as meaning the natural genomic or chromosomal locus in the original plant or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences with the corresponding nucleic acid sequence encoding a polypeptide useful in the methods of the present invention, as defined above—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

A transgenic plant for the purposes of the invention is thus understood as meaning, as above, that the nucleic acids used in the method of the invention are not at their natural locus in the genome of said plant, it being possible for the nucleic acids to be expressed homologously or heterologously. However, as mentioned, transgenic also means that, while the nucleic acids according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acids according to the invention at an unnatural locus in the genome, i.e. homologous or, preferably, heterologous expression of the nucleic acids takes place. Preferred transgenic plants are mentioned herein.

Transformation

The term "introduction" or "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

The transfer of foreign genes into the genome of a plant is called transformation. Transformation of plant species is now a fairly routine technique. Advantageously, any of several transformation methods may be used to introduce the gene of interest into a suitable ancestor cell. The methods described for the transformation and regeneration of plants from plant tissues or plant cells may be utilized for transient or for stable transformation. Transformation methods include the use of liposomes, electroporation, chemicals that increase free DNA uptake, injection of the DNA directly into the plant, particle gun bombardment, transformation using viruses or pollen and microprojection. Methods may be selected from the calcium/polyethylene glycol method for protoplasts (Krens, F. A. et al., (1982) Nature 296, 72-74; Negrutiu I et al. (1987) Plant Mol Biol 8: 363-373); electroporation of protoplasts (Shillito R. D. et al. (1985) Bio/Technol 3, 1099-1102); microinjection into plant material (Crossway A et al., (1986) Mol. Gen Genet 202: 179-185); DNA or RNA-coated particle bombardment (Klein T M et al., (1987) Nature 327: 70) infection with (non-integrative) viruses and the like. Transgenic plants, including transgenic crop plants, are preferably produced via *Agrobacterium*-mediated transformation. An advantageous transformation method is the transformation in planta. To this end, it is possible, for example, to allow the agrobacteria to act on plant seeds or to inoculate the plant meristem with agrobacteria. It has proved particularly expedient in accordance with the invention to allow a suspension of transformed agrobacteria to act on the intact plant or at least on the flower primordia. The plant is subsequently grown on until the seeds of the treated plant are obtained (Clough and Bent, Plant J. (1998) 16, 735-743). Methods for *Agrobacterium*-mediated transformation of rice include well known methods for rice transformation, such as those described in any of the following: European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physiol 129(1): 13-22, 2002), which disclosures are incorporated by reference herein as if fully set forth. Said methods are further described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). Agrobacteria transformed by such a vector can then be used in known manner for the transformation of plants, such as plants used as a model, like *Arabidopsis* (*Arabidopsis thaliana* is within the scope of the present invention not considered as a crop plant), or crop plants such as, by way of example, tobacco plants, for example by immersing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with agrobacteria and seeds are obtained from the developing plants of which a certain proportion is transformed and thus transgenic [Feldman, K A and Marks M D (1987). Mol Gen Genet 208:274-289; Feldmann K (1992). In: C Koncz, N-H Chua and J Shell, eds, Methods in *Arabidopsis* Research. Word Scientific, Singapore, pp. 274-289]. Alternative methods are based on the repeated removal of the inflorescences and incubation of the excision site in the center of the rosette with transformed agrobacteria, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension [Bechthold, N (1993). C R Acad Sci Paris Life Sci, 316: 1194-1199], while in the case of the "floral dip" method the developing floral tissue is incubated briefly with a surfactant-treated agrobacterial suspension [Clough, S J and Bent A F (1998) The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process which has been schematically displayed in Klaus et al., 2004 [Nature Biotechnology 22 (2), 225-229]. Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview is given in Bock (2001) Transgenic plastids in basic research and plant biotechnology. J Mol Biol. 2001 Sep. 21; 312 (3): 425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229).

T-DNA Activation Tagging

T-DNA activation tagging (Hayashi et al. Science (1992) 1350-1353), involves insertion of T-DNA, usually containing a promoter (may also be a translation enhancer or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through *Agrobacterium* infection and leads to modified expression of genes near the inserted T-DNA. The resulting transgenic plants show dominant phenotypes due to modified expression of genes close to the introduced promoter.

TILLING

The term "TILLING" is an abbreviation of "Targeted Induced Local Lesions In Genomes" and refers to a mutagenesis technology useful to generate and/or identify nucleic acids encoding proteins with modified expression and/or activity. TILLING also allows selection of plants carrying such mutant variants. These mutant variants may exhibit modified expression, either in strength or in location or in timing (if the mutations affect the promoter for example). These mutant variants may exhibit higher activity than that exhibited by the gene in its natural form. TILLING combines high-density mutagenesis with high-throughput screening methods. The steps typically followed in TILLING are: (a) EMS mutagenesis (Redei G P and Koncz C (1992) In Methods in *Arabidopsis* Research, Koncz C, Chua N H, Schell J, eds. Singapore, World Scientific Publishing Co, pp. 16-82; Feldmann et al., (1994) In Meyerowitz E M, Somerville C R, eds, *Arabidopsis*. Cold Spring Harbor Laboratory Press, Cold Spring Harbor, N.Y., pp 137-172; Lightner J and Caspar T (1998) In J Martinez-Zapater, J Salinas, eds, Methods on Molecular Biology, Vol. 82. Humana Press, Totowa, N.J., pp 91-104); (b) DNA preparation and pooling of individuals; (c) PCR amplification of a region of interest; (d) denaturation and annealing to allow formation of heteroduplexes; (e) DHPLC, where the presence of a heteroduplex in a pool is detected as an extra peak in the chromatogram; (f) identification of the mutant individual; and (g) sequencing of the mutant PCR product. Methods for TILLING are well known in the art (McCallum et al., (2000) Nat Biotechnol 18: 455-457; reviewed by Stemple (2004) Nat Rev Genet 5(2): 145-50).

Homologous Recombination

Homologous recombination allows introduction in a genome of a selected nucleic acid at a defined selected position. Homologous recombination is a standard technology used routinely in biological sciences for lower organisms such as yeast or the moss *Physcomitrella*. Methods for performing homologous recombination in plants have been described not only for model plants (Offringa et al. (1990) EMBO J 9(10): 3077-84) but also for crop plants, for example rice (Terada et al. (2002) Nat Biotech 20(10): 1030-4; Iida and Terada (2004) Curr Opin Biotech 15(2): 132-8), and approaches exist that are generally applicable regardless of the target organism (Miller et al, Nature Biotechnol. 25, 778-785, 2007).

Yield

The term "yield" in general means a measurable produce of economic value, typically related to a specified crop, to an area, and to a period of time. Individual plant parts directly contribute to yield based on their number, size and/or weight, or the actual yield is the yield per square meter for a crop and year, which is determined by dividing total production (includes both harvested and appraised production) by planted square meters. The term "yield" of a plant may relate to vegetative biomass (root and/or shoot biomass), to reproductive organs, and/or to propagules (such as seeds) of that plant.

Early Vigour

"Early vigour" refers to active healthy well-balanced growth especially during early stages of plant growth, and may result from increased plant fitness due to, for example, the plants being better adapted to their environment (i.e. optimizing the use of energy resources and partitioning between shoot and root). Plants having early vigour also show increased seedling survival and a better establishment of the crop, which often results in highly uniform fields (with the crop growing in uniform manner, i.e. with the majority of plants reaching the various stages of development at substantially the same time), and often better and higher yield. Therefore, early vigour may be determined by measuring various factors, such as thousand kernel weight, percentage germination, percentage emergence, seedling growth, seedling height, root length, root and shoot biomass and many more.

Increase/Improve/Enhance

The terms "increase", "improve" or "enhance" are interchangeable and shall mean in the sense of the application at least a 3%, 4%, 5%, 6%, 7%, 8%, 9% or 10%, preferably at least 15% or 20%, more preferably 25%, 30%, 35% or 40% more yield and/or growth in comparison to control plants as defined herein.

Seed Yield

Increased seed yield may manifest itself as one or more of the following: a) an increase in seed biomass (total seed weight) which may be on an individual seed basis and/or per plant and/or per square meter; b) increased number of flowers per plant; c) increased number of (filled) seeds; d) increased seed filling rate (which is expressed as the ratio between the number of filled seeds divided by the total number of seeds); e) increased harvest index, which is expressed as a ratio of the yield of harvestable parts, such as seeds, divided by the total biomass; and f) increased thousand kernel weight (TKW), and g) increased number of primary panicles, which is extrapolated from the number of filled seeds counted and their total weight. An increased TKW may result from an increased seed size and/or seed weight, and may also result from an increase in embryo and/or endosperm size.

An increase in seed yield may also be manifested as an increase in seed size and/or seed volume. Furthermore, an increase in seed yield may also manifest itself as an increase in seed area and/or seed length and/or seed width and/or seed perimeter. Increased seed yield may also result in modified architecture, or may occur because of modified architecture.

Greenness Index

The "greenness index" as used herein is calculated from digital images of plants. For each pixel belonging to the plant object on the image, the ratio of the green value versus the red value (in the RGB model for encoding color) is calculated. The greenness index is expressed as the percentage of pixels for which the green-to-red ratio exceeds a given threshold. Under normal growth conditions, under salt stress growth conditions, and under reduced nutrient availability growth conditions, the greenness index of plants is measured in the last imaging before flowering. In contrast, under drought stress growth conditions, the greenness index of plants is measured in the first imaging after drought.

Plant

The term "plant" as used herein encompasses whole plants, ancestors and progeny of the plants and plant parts, including seeds, shoots, stems, leaves, roots (including tubers), flowers, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprises the gene/nucleic acid of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agave sisalana, Agropyron* spp., *Agrostis stolonifera, Allium* spp., *Amaranthus* spp., *Ammophila arenaria, Ananas comosus, Annona* spp., *Apium graveolens, Arachis* spp, *Artocarpus* spp., *Asparagus officinalis, Avena* spp. (e.g. *Avena sativa, Avena fatua, Avena byzantina, Avena fatua* var. *sativa, Avena hybrida*), *Averrhoa carambola, Bambusa* sp., *Beninkasa hispida, Bertholletia excelsea, Beta vulgaris, Brassica* spp. (e.g. *Brassica napus, Brassica rapa* ssp. [canola, oilseed rape, turnip rape]), *Cadaba farinosa, Camellia sinensis, Canna indica, Cannabis sativa, Capsicum* spp., *Carex elata, Carica papaya, Carissa macrocarpa, Carya* spp., *Carthamus tinctorius, Castanea* spp., *Ceiba pentandra, Cichorium endivia, Cinnamomum* spp., *Citrullus lanatus, Citrus* spp., *Cocos* spp., *Coffea* spp., *Colocasia esculenta, Cola* spp., *Corchorus* sp., *Coriandrum sativum, Corylus* spp., *Crataegus* spp., *Crocus sativus, Cucurbita* spp., *Cucumis* spp., *Cynara* spp., *Daucus carota, Desmodium* spp., *Dimocarpus longan, Dioscorea* spp., *Diospyros* spp., *Echinochloa* spp., *Elaeis* (e.g. *Elaeis guineensis, Elaeis oleifera*), *Eleusine coracana, Eragrostis tef, Erianthus* sp., *Eriobotrya japonica, Eucalyptus* sp., *Eugenia uniflora, Fagopyrum* spp., *Fagus* spp., *Festuca arundinacea, Ficus carica, Fortunella* spp., *Fragaria* spp., *Ginkgo biloba, Glycine* spp. (e.g. *Glycine max, Soja hispida* or *Soja max*), *Gossypium hirsutum, Helianthus* spp. (e.g. *Helianthus annuus*), *Hemerocallis fulva, Hibiscus* spp., *Hordeum* spp. (e.g. *Hordeum vulgare*), *Ipomoea batatas, Juglans* spp., *Lactuca sativa, Lathyrus* spp., *Lens culinaris, Linum usitatissimum, Litchi chinensis, Lotus* spp., *Luffa acutangula, Lupinus* spp., *Luzula sylvatica, Lycopersicon* spp. (e.g. *Lycopersicon esculentum, Lycopersicon lycopersicum, Lycopersicon pyriforme*), *Macrotyloma* spp., *Malus* spp., *Malpighia emarginata, Mammea americana, Mangifera indica, Manihot* spp., *Manilkara zapota, Medicago sativa, Melilotus* spp., *Mentha* spp., *Miscanthus sinensis, Momordica* spp., *Morus nigra, Musa* spp., *Nicotiana* spp., *Olea* spp., *Opuntia* spp., *Ornithopus* spp., *Oryza* spp. (e.g. *Oryza sativa, Oryza latifolia*), *Panicum miliaceum, Panicum virgatum, Passiflora edulis, Pastinaca sativa, Pennisetum* sp., *Persea* spp., *Petroselinum crispum, Phalaris arundinacea, Phaseolus* spp., *Phleum pratense, Phoenix* spp., *Phragmites australis, Physalis* spp., *Pinus* spp., *Pistacia vera, Pisum* spp., *Poa* spp., *Populus* spp., *Prosopis* spp., *Prunus* spp., *Psidium* spp., *Punica granatum, Pyrus communis, Quercus* spp., *Raphanus sativus, Rheum rhabarbarum, Ribes* spp., *Ricinus communis, Rubus* spp., *Saccharum* spp., *Salix* sp., *Sambucus* spp., *Secale cereale, Sesamum* spp., *Sinapis* sp., *Solanum* spp. (e.g. *Solanum tuberosum, Solanum integrifolium* or *Solanum lycopersicum*), *Sorghum bicolor, Spinacia* spp., *Syzygium* spp., *Tagetes* spp., *Tamarindus indica, Theobroma cacao, Trifolium* spp., *Tripsacum dactyloides, Triticale* sp., *Triticosecale rimpaui, Triticum* spp. (e.g. *Triticum aestivum, Triticum durum, Triticum turgidum, Triticum hybernum, Triticum macha, Triticum sativum, Triticum monococcum* or *Triticum vulgare*), *Tropaeolum minus, Tropaeolum majus, Vaccinium* spp., *Vicia* spp., *Vigna* spp., *Viola odorata, Vitis* spp., *Zea mays, Zizania palustris, Ziziphus* spp., amongst others.

DETAILED DESCRIPTION OF THE INVENTION

Surprisingly, it has now been found that modulating expression in a plant of a nucleic acid encoding a TFL1_Like polypeptide gives plants having enhanced yield-related traits relative to control plants. According to a first embodiment, the present invention provides a method for enhancing yield-related traits in plants relative to control plants, comprising modulating expression in a plant of a nucleic acid encoding a TFL1_like polypeptide and optionally selecting for plants having enhanced seed yield.

Furthermore, surprisingly, it has now been found that modulating expression in a plant of a nucleic acid encoding an R5PI polypeptide gives plants having enhanced yield-related traits relative to control plants. According to a first embodiment, the present invention provides a method for enhancing yield-related traits in plants relative to control plants, comprising modulating expression in a plant of a nucleic acid encoding an R5PI polypeptide and optionally selecting for plants having enhanced seed yield.

Furthermore, surprisingly, it has now been found that increasing expression in a plant of a nucleic acid sequence encoding a Znf A20/AN1 polypeptide gives plants having increased yield-related traits relative to control plants. According to a first embodiment, the present invention provides a method for increasing yield-related traits in plants relative to control plants, comprising increasing expression in a plant of a nucleic acid sequence encoding a Znf A20/AN1 polypeptide.

Concerning Znf A20/AN1 polypeptides, the invention also provides hitherto unknown nucleic acid sequences encoding Znf A20/AN1 polypeptides, and Znf A20/AN1 polypeptides.

According to an embodiment of the present invention, there is therefore provided an isolated nucleic acid sequence comprising:
- (i) a nucleic acid sequence as represented by any one of SEQ ID NOs: 280, 282, 284, 286, 288, 290, 292, 294, 296, 298, 300, 302, 304, 306, 308, 310, 312, 314, 316, 318, 320, 322, 324, 326, 328, 330, 332, 334, or 336;
- (ii) the complement of a nucleic acid sequence as represented by any one of SEQ ID NOs: 280, 282, 284, 286, 288, 290, 292, 294, 296, 298, 300, 302, 304, 306, 308, 310, 312, 314, 316, 318, 320, 322, 324, 326, 328, 330, 332, 334, or 336;
- (iii) a nucleic acid sequence encoding a polypeptide having, in increasing order of preference, at least 70%, 75%, 80%, 85%, 90%, 95%, 96%, 97%, 98%, 99% or more amino acid sequence identity to the polypeptide sequence as represented by any one of SEQ ID NOs: 70, 72, 74, 76, 78, 80, 82, 84, 86, 88, 90, 92, 94, 96, 98, 100, 102, 104, 106, 108, 110, 112, 114, 116, 118, 120, 122, 124, or 126;

According to a further embodiment of the present invention, there is also provided an isolated polypeptide comprising:
- (i) a polypeptide sequence represented by any one of SEQ ID NOs: 281, 283, 285, 287, 289, 291, 293, 295, 297, 299, 301, 303, 305, 307, 309, 311, 313, 315, 317, 319, 321, 323, 325, 327, 329, 331, 333, 335, or 337;
- (ii) a polypeptide sequence having, in increasing order of preference, at least 70%, 75%, 80%, 85%, 90%, 95%, 96%, 97%, 98%, 99% or more amino acid sequence identity to the polypeptide sequence as represented by any one of SEQ ID NOs: 281, 283, 285, 287, 289, 291, 293, 295, 297, 299, 301, 303, 305, 307, 309, 311, 313, 315, 317, 319, 321, 323, 325, 327, 329, 331, 333, 335, or 337;
- (iii) derivatives of any of the polypeptide sequences given in (i) or (ii) above.

Furthermore, surprisingly, it has now been found that increasing expression in a plant of a nucleic acid sequence encoding a PHD-zf polypeptide as defined herein, gives plants having increased seed yield-related traits relative to control plants. According to a first embodiment, the present invention provides a method for increasing seed yield-related traits in plants relative to control plants, comprising increasing expression in a plant of a nucleic acid sequence encoding a PHD-zf polypeptide.

Concerning PHD-zf polypeptides, the invention also provides hitherto unknown nucleic acid sequences encoding PHD-zf polypeptides, and PHD-zf polypeptides.

According to one embodiment of the present invention, there is therefore provided an isolated nucleic acid molecule selected from:
- (i) a nucleic acid sequence as represented by SEQ ID NO: 475, SEQ ID NO: 477, SEQ ID NO: 479, SEQ ID NO: 481, SEQ ID NO: 483, SEQ ID NO: 485, SEQ ID NO: 487, SEQ ID NO: 489;
- (ii) the complement of a nucleic acid sequence as represented by SEQ ID NO: 475, SEQ ID NO: 477, SEQ ID NO: 479, SEQ ID NO: 481, SEQ ID NO: 483, SEQ ID NO: 485, SEQ ID NO: 487, SEQ ID NO: 489;
- (iii) a nucleic acid sequence encoding a PHD-zf polypeptide having, in increasing order of preference, at least 50%, 55%, 60%, 65%, 70%, 75%, 80%, 85%, 90%, 95%, 96%, 97%, 98%, 99% or more amino acid sequence identity to the polypeptide sequence represented by SEQ ID NO: 348, and having in increasing order of preference at least 50%, 55%, 60%, 65%, 70%, 75%, 80%, 85%, 90%, 95%, 96%, 97%, 98%, 99% or more sequence identity to SEQ ID NO: 491 (which represents the Conserved Domain of SEQ ID NO: 348).

According to a further embodiment of the present invention, there is also provided an isolated polypeptide selected from:
- (i) a polypeptide sequence as represented by SEQ ID NO: 476, SEQ ID NO: 478, SEQ ID NO: 480, SEQ ID NO: 482, SEQ ID NO: 484, SEQ ID NO: 486, SEQ ID NO: 488, SEQ ID NO: 490;
- (ii) a polypeptide sequence having, in increasing order of preference, at least 50%, 55%, 60%, 65%, 70%, 75%, 80%, 85%, 90%, 95%, 96%, 97%, 98%, 99% or more amino acid sequence identity to a polypeptide sequence as represented by any one of SEQ ID NO: 476, SEQ ID NO: 478, SEQ ID NO: 480, SEQ ID NO: 482, SEQ ID NO: 484, SEQ ID NO: 486, SEQ ID NO: 488, SEQ ID NO: 490;
- (iii) derivatives of any of the polypeptide sequences given in (i) or (ii) above.

Furthermore, surprisingly, it has now been found that modulating expression in a plant of a nucleic acid encoding a REF/ALY polypeptide gives plants having enhanced yield-related traits relative to control plants. According to a first embodiment, the present invention provides a method for enhancing yield-related traits in plants relative to control plants, comprising modulating expression in a plant of a nucleic acid encoding a REF/ALY polypeptide.

Concerning TFL1-like polypeptides, a preferred method for modulating (preferably, increasing) expression of a nucleic acid encoding a TFL1-like polypeptide is by introducing and expressing in a plant a nucleic acid encoding a TFL1-like polypeptide. The increase in expression is in increasing order of preference more than 0.1, 0.2, 0.3, 0.4, 0.5, 0.6, 0.7, 0.8, 0.9, 1, 2, 3, 4, 5, 6, 7, 8, 9, 10, 15, 20, 25, 30, 35, 40, 45, 50, 60, 70, 80, 90, 100 times or more the level of expression of a TFL1-like gene in the natural plant. Methods to measure the expression level of a gene are well known in the art (Sambrook et al. 1989).

Concerning R5PI polypeptides, a preferred method for modulating (preferably, increasing) expression of a nucleic acid encoding an R5PI polypeptide is by introducing and expressing in a plant a nucleic acid encoding an R5PI polypeptide. The increase in expression is in increasing order of preference more than 1, 2, 3, 4, 5, 6, 7, 8, 9, 10, 15, 20, 25, 30, 35, 40, 45, 50, 60, 70, 80, 90, 100 times the level of expression of the same and/or the homologous R5PI gene in a plant that has not been modified to increase the expression of that R5PI gene. Methods to measure the expression level of a gene are well known in the art (Sambrook et al. 1989).

Concerning Znf A20/AN1 polypeptides, a preferred method for increasing expression of a nucleic acid sequence encoding a Znf A20/AN1 polypeptide is by introducing and expressing in a plant a nucleic acid sequence encoding a Znf A20/AN1 polypeptide.

Concerning PHD-zf polypeptides, a preferred method for increasing expression in a plant of a nucleic acid sequence encoding a PHD-zf polypeptide is by introducing and expressing in a plant a nucleic acid sequence encoding a PHD-zf polypeptide.

Concerning REF/ALY polypeptides, a preferred method for modulating (preferably, increasing) expression of a nucleic acid encoding a REF/ALY polypeptide is by introducing and expressing in a plant a nucleic acid encoding a REF/ALY polypeptide. The increase in expression is in increasing order of preference more than 1, 2, 3, 4, 5, 6, 7, 8, 9, 10, 15, 20, 25, 30, 35, 40, 45, 50, 60, 70, 80, 90, 100 times the level of expression of the same and/or the homologous nucleic acid encoding a REF/ALY polypeptide in a control. Methods to measure the expression level of a gene are well known in the art (Sambrook et al. 1989; John Wiley & Sons 1989 and yearly updates).

Concerning TFL1-like polypeptides, any reference hereinafter to a "protein useful in the methods of the invention" is taken to mean a TFL1-like polypeptide as defined herein. Any reference hereinafter to a "nucleic acid useful in the methods of the invention" is taken to mean a nucleic acid capable of encoding such a TFL1-like polypeptide. The nucleic acid to be introduced into a plant (and therefore useful in performing the methods of the invention) is any nucleic acid encoding the type of protein which will now be described, hereinafter also named "TFL1-like nucleic acid" or "TFL1-like gene".

A "TFL1-like polypeptide" as defined herein refers to any polypeptide comprising a phosphatidylethanolamine-binding protein (PEBP) domain (domain accession number in pfam: PFAM01161) and having a conserved Histidine (His or H) or a Tyrosine (Tyr or Y) amino acid residue at a location equivalent to that of amino acid residues His86 (H86) in SEQ ID NO: 2 and a conserved Aspartic amino acid (D) or a Glutamic amino acid (Glu) residue at a location equivalent to that of amino acid residues Asp142 (D142) in SEQ ID NO: 2.

His86 refers to the Histidine residue found at amino acid position 86 in SEQ ID NO: 2. Similarly, Asp142 (D142) refers to the Aspartic amino acid residue found at amino acid position 142 in SEQ ID NO: 2

A preferred TFL1-like polypeptide of the invention refers to any polypeptide comprising:
(ii) a phosphatidylethanolamine-binding protein (PEBP) domain (domain accession number in pfam: PFAM01161), preferably as present in any one the polypeptides of Table A1, more preferably as represented by the sequence comprised between amino acids 66-88 in SEQ ID NO: 2, even more preferably as present in SEQ ID NO: 26 (*P.trichocarpa_575797_BFT*); and
(iii) a conserved Histidine (His or H) or preferably a Tyrosine (Tyr or Y) residue at a location equivalent to that of amino acid residues His86 (H86) in SEQ ID NO: 2 and a conserved Aspartic amino acid (D) or preferably a Glutamic amino acid (Glu) residue at a location equivalent to that of amino acid residues Asp142 (D142) in SEQ ID NO: 2.

Alternatively, a preferred TFL1-like polypeptide of the invention refers to any polypeptide comprising:
(ii) a protein domain having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to the PEBP domain in SEQ ID NO: 26; and
(iii) a conserved Histidine (His or H) or preferably a Tyrosine (Tyr or Y) residue at a location equivalent to that of amino acid residues His86 (H86) in SEQ ID NO: 2 and a conserved Aspartic amino acid (D) or preferably a Glutamic amino acid (Glu) residue at a location equivalent to that of amino acid residues Asp142 (D142) in SEQ ID NO: 2.

Alternatively, a preferred TFL1-like polypeptide of the invention refers to any polypeptide comprising:
(i) a phosphatidylethanolamine-binding protein (PEBP) domain (domain accession number in pfam: PFAM01161), preferably as present in any one the polypeptides of Table A1, more preferably represented by the sequence comprised between amino acids 66-88 in SEQ ID NO: 2, even more preferably as present in SEQ ID NO: 25, wherein in increasing order of preference 0, 1, 2, 3, 4, 5, 6, 7, 8, 9, 10, 11, 12, 13, 14, 15, 16, 17, 18, 19, 20, 21, 22, 23, 24, 25 amino acids may be substituted by any amino acid, preferably by a conservative amino acid; and
(ii) a conserved Histidine (His or H) or preferably a Tyrosine (Tyr or Y) amino acid residue at a location equivalent to that of amino acid residues His86 (H86) in SEQ ID NO: 2 and a conserved Aspartic amino acid (D) or preferably a Glutamic amino acid (Glu) residue at a location equivalent to that of amino acid residues Asp142 (D142) in SEQ ID NO: 2.

Phosphatidylethanolamine-binding protein (PEBP) domain (domain accession number in pfam: PFAM01161 corresponding to Interpro entry number IPR008914) is a conserved sequence of approximately 145 amino acids in length present in Phosphatidylethanolamine-binding proteins. The structure of a PEBP domain consists of a large central beta-sheet flanked by a smaller beta-sheet on one side, and an alpha helix on the other. Sequence alignments (see Examples section) show two conserved central regions, which form a consensus signature for the PEBP family. These two regions form part of the ligand-binding site, which can accommodate various anionic groups. A Phosphatidylethanolamine-binding protein (PEBP) domain is represented by the amino acid sequence found in SEQ ID NO: 2 located between amino acids 12-170. The conserved Phosphatidyltehanolamine binding site found in PEBP domains may be represented by the sequence comprised between amino acids 66-88 in SEQ ID NO: 2.

A preferred TFL1 polypeptide useful in the methods of the invention comprises a domain having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the PEBP domain in SEQ ID NO: 2, provided that the polypeptide comprises the conserved amino acid residues as outlined above.

TFL1-like polypeptides useful in the methods of the invention posses a conserved amino acid residue at a position equivalent to the Histidine 86 of SEQ ID NO: 2 and at a position equivalent to residue 142 of SEQ ID NO: 2. Tools to determine amino acid residues in a TFL-like polypeptide at a location equivalent to that of amino acid residues His86 (H86) and Asp142 (D142) in SEQ ID NO: 2 are readily available to the person skilled in the art. For example, a comparison in a sequence alignment of two polypeptides allows the identifying of the equivalent amino acids in the two polypeptides at a given location. Preferred methods to perform the alignment are well known in the art and preferably make use of the algorithm of Needleman and Wunsch ((1970) J Mol Biol 48: 443-453). Alternatively, a local alignment may be performed to identify equivalent residues amongst polypeptides. For local alignments, the Smith-Waterman algorithm is preferred (Smith T F, Waterman M S (1981) J. Mol. Biol 147(1); 195-7). Additionally multiple alignments of protein sequences may be used to identify amino acid residues at equivalent locations. The identification in TFL1-like polypeptides of the conserved Histidine and Aspartic amino acid residues at a location equivalent to that of amino acid residues His86 (H86) and Asp142 (D142) in SEQ ID NO: 2 is illustrated in the Examples section. Alternatively, equivalent amino acid residues between polypeptides may be determined by comparing their tertiary structures (Ahn et al. 2006. EMBO, 25, 605-614).

Additionally, TFL1-like polypeptides useful in the methods of the invention may comprise a conserved amino acid region corresponding to segment B as defined by Anh et al. 2007 which comprises characteristic amino acid triads. Preferably TFL1-like polypeptides useful in the methods of the invention comprise a conserved amino acid triad located at a position equivalent to amino acid residues 152-154 of SEQ ID NO: 2 and represented in increasing order of preference by any one of SEQ ID NO: 138-139, SEQ ID NO: 129-139 (YNG, ENG, END, ENE, ENG, DNG, QND, VND, DND, ENN and EYD).

Additionally a TFL1-like polypeptide useful in the method of the invention typically comprises
A. a sequence having in increasing order of preference 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% to any one of the following motifs:
  (i) Motif 1 (SEQ ID NO: 121: EHI/LHV)
  (ii) Motif 2 (SEQ ID NO: 122: IPGTTD)
  (iii) Motif 3 (SEQ ID NO: 123: (I/V/A)GIHRF/Y)
  (iv) Motif 4 (SEQ ID NO: 124: TRRGSWSVPSYRDQ)
  (v) Motif 5 (SEQ ID NO: 125: TAARRR/K)
or alternatively,
B. a motif having a sequence as represented by any one of SEQ ID NO: 121 to SEQ ID NO: 125, wherein in increasing order of preference 0, 1, 2, 3, 4, 5 amino acids may be substituted by any amino acid, preferably by a conservative amino acid.

Preferably, a TFL1-like polypeptide useful in the method of the invention comprises Motif 1, 2, 3 and 5, more preferably Motif 1, 2, 3 and 5 as present in SEQ ID NO: 26 (P.trichocarpa_575797_BFT).

Alternatively, a TFL1-like polypeptide of the invention refers to any orthologue, paralogue or homologue of a TFL1 or a BFT protein. TFL1 and BFT polypeptides are well known in the art.

Alternatively, the homologue of a TFL1-like protein has in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 2, provided that the homologous protein comprises the conserved amino acid residues as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered.

Alternatively, a preferred polypeptide useful in the methods of the invention has a sequence which when used in the construction of a phylogenetic tree, such as the one depicted in FIG. 2 of Carmona et al. 2007, clusters with the group of TFL1-like polypeptides comprising the amino acid sequence represented by SEQ ID NO: 2 rather than with any other group. Further preferably the polypeptide sequence clusters with the clade comprising the Arabidopsis ATC, the Anthirrinum CEN, the Lycopersicum SP, the Nicotiana CET2 and the Vitis VvTFL1A polypeptide. FIG. 2 of Carmona et al. 2007 is herein depicted in FIG. 2A.

Alternatively, a yet further preferred polypeptide useful in the methods of the invention has a sequence which when used in the construction of a phylogenetic tree, such as the one depicted in FIG. 2 of Igasaki et al. 2008 (Plant Cell Physiol. 49(3): 291-300,) clusters in the TFL1 clade, more preferably in the even BFT (Brother of FT) clade, more preferably with BFT. FIG. 2 of Igasaki et al. 2008 is depicted in FIG. 2B.

Concerning R5PI polypeptides, preferably the increased expression of a nucleic acid encoding an R5PI polypeptide in a plant results in increased levels of D-ribose-5-phosphate isomerase activity relative to control plants. More preferably the levels of D-ribose-5-phosphate isomerase activity are increased in the cytosol of the cell. Most preferably the activity of the cytosolic fraction of R5PI polypeptide increased when compared to the chloroplastic fraction. Methods to fractionate the protein content of cellular compartments such as cytosol and chloroplast of a plant cell are well known in the art (Ausubel et al. 1994).

Any reference hereinafter to a "protein useful in the methods of the invention" is taken to mean an R5PI polypeptide as defined herein. Any reference hereinafter to a "nucleic acid useful in the methods of the invention" is taken to mean a nucleic acid capable of encoding such an R5PI polypeptide. The nucleic acid to be introduced into a plant (and therefore useful in performing the methods of the invention) is any nucleic acid encoding the type of protein which will now be described, hereafter also named "R5PI nucleic acid" or "R5PI gene".

An "R5PI polypeptide" as defined herein refers to any polypeptide comprising a Rib_5-P_isom_A (RiPA) domain with accession number in pfam: PFAM06026), and having Ribose-5-phosphate isomerase activity.

Ribose-5-phosphate isomerase (EC 5.3.1.6) is an enzyme that catalyzes the chemical reaction for interconversion of D-ribose 5-phosphate into D-ribulose 5-phosphate. Methods to measure Ribose-5-phosphate isomerase activity are well known in the art Jung et al. 2000 Arch Biochm biophys 373, 409-17; Gontero et al. 1988 173, 437-43).

Rib_5-P_isom_A (RiPA) domain with accession number in pfam: PFAM06026) refers to a conserved amino acid sequence of about 170 amino acids in length which is present in Ribose 5-phosphate isomerase A (phosphoriboisomerase A) polypeptides. The terciary structure of a number of phosphoriboisomerase A polypeptides has been elucidated (Holmes et al; 2006 Acta Crystallogr Sect F Struct Biol Cryst Commun; 62(Pt 5): 427-431).

A Rib_5-P_isom_A (RiPA) domain is represented by the amino acid sequence located between amino acid residues 77-261 of SEQ ID NO: 141. The RiPA domain comprises a conserved sequence motif DGADE (SEQ ID NO: 206) corresponding to amino acid residues 111-115 in SEQ ID NO: 141 which are part of the active site of the phosphoriboisomerase A enzyme.

A preferred R5PI polypeptide useful in the methods of the invention comprises a domain having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the RIPA domain in SEQ ID NO: 141 (SEQ ID NO: 204).

Additionally, phosphoriboisomerase A enzymes typically comprise the following conserved amino acid motifs:
Motif 6: GXGXGST
Motif 7: DGADE
Motif 8: KGxG(G/A)
Motif 9: GV(V/I)(E/D)HG(M/L)F A preferred R5PI polypeptide useful in the methods of the invention comprises any one or more of the following motifs:
(i) Motif 1: GXGXGST (SEQ ID NO: 205), wherein 1, 2, or 3 residues may be substituted by any amino acid.
(ii) Motif 2: DGADE (SEQ ID NO: 206), wherein 1, 2, or 3 residues may be substituted by any amino acid.
(iii) Motif 3: KGxG(G/A) (SEQ ID NO: 207), wherein 1, 2, or 3 residues may be substituted by any amino acid.
(iv) Motif 4:GV(V/I)(E/D)HG(M/L)F, (SEQ ID NO: 208), wherein 1, 2, or 3 residues may be substituted by any amino acid.

Alternatively, the homologue of an R5PI protein has in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 141.

Preferably, the R5PI polypeptide useful in the methods of the invention is one which when used in the construction of a phylogenetic tree, such as the one depicted in FIG. 5, clusters with group I comprising the amino acid sequence represented by SEQ ID NO: 141 rather than with any other group.

Concerning Znf A20/AN1 polypeptides, any reference hereinafter to a "protein useful in the methods of the invention" is taken to mean a Znf A20/AN1 polypeptide as defined herein. Any reference hereinafter to a "nucleic acid sequence useful in the methods of the invention" is taken to mean a nucleic acid sequence capable of encoding such a Znf A20/AN1 polypeptide. The nucleic acid sequence to be introduced into a plant (and therefore useful in performing the methods of the invention) is any nucleic acid sequence encoding the type of polypeptide, which will now be described, hereafter also named "Znf A20/AN1 nucleic acid sequence" or "Znf A20/AN1 gene".

A "Znf A20/AN1 polypeptide" as defined herein refers to any polypeptide comprising: (i) at least one A20-type zinc finger domain with an InterPro accession IPR002653 (ProSite accession PS51036); and (ii) at least one AN1-type zinc finger domain with an InterPro accession IPR000058 (ProSite accession PS51039).

Alternatively or additionally, a "Znf A20/AN1 polypeptide" as defined herein refers to any polypeptide comprising: (i) a domain having at least 40%, 45%, 50%, 55%, 60%, 65%, 70%, 75%, 80%, 85%, 90%, 95%, 98%, 99% or more amino acid sequence identity to an A20-type zinc finger domain as represented by SEQ ID NO: 338, or by SEQ ID NO: 339; and (ii) a domain having at least 40%, 45%, 50%, 55%, 60%, 65%, 70%, 75%, 80%, 85%, 90%, 95%, 98%, 99% or more amino acid sequence identity to an AN1-type zinc finger domain as represented by SEQ ID NO: 340, or by SEQ ID NO: 341.

Alternatively or additionally, a "Znf A20/AN1 polypeptide" as defined herein refers to any polypeptide having in increasing order of preference at least 40%, 45%, 50%, 55%, 60%, 65%, 70%, 75%, 80%, 85%, 90%, 95%, 98%, 99% or more amino acid sequence identity to the Znf A20/AN1 polypeptide as represented by SEQ ID NO: 213, or by SEQ ID NO: 215, or to any of the full length polypeptide sequences given in Table A3 herein.

Alternatively or additionally, a "Znf A20/AN1 polypeptide" comprises an A20 zinc finger domain and an AN1 zinc finger domain that interact with each other in a yeast two-hybrid interaction assay (Kanneganti et al. (2008) Plant Molec Biol 66: 445-462).

Concerning PHD-zf polypeptides, any reference hereinafter to a "protein useful in the methods of the invention" is taken to mean a polypeptide as defined herein. Any reference hereinafter to a "nucleic acid sequence useful in the methods of the invention" is taken to mean a nucleic acid sequence capable of nucleic acid sequence" or "PHD-zf gene".

A "PHD-zf polypeptide" as defined herein refers to any polypeptide comprising (i) in increasing order of preference at least 50%, 55%, 60%, 65%, 70%, 75%, 80%, 85%, 90%, 95%, 98%, 99% or more amino acid sequence identity to a Conserved Domain as represented by SEQ ID NO: 491; and (ii) in increasing order of preference at least 50%, 55%, 60%, 65%, 70%, 75%, 80%, 85%, 90%, 95%, 98%, 99% or more amino acid sequence identity to a plant homeodomain zinc finger (PHD-zf) domain with an InterPro accession IPR001965 as represented by SEQ ID NO: 492.

Additionally, a "PHD-zf polypeptide" as defined herein further comprises one or more of: (i) a predicted transmembrane domain; (ii) an E/D rich motif; and (iii) a zinc finger with the consensus sequence $CXXC_{8-21}CXXC_4 HXXC_{12-46}CXXC$, where C is Cys and H is His.

Alternatively or additionally, a "PHD-zf polypeptide" as defined herein refers to any polypeptide sequence having in increasing order of preference at least 50%, 55%, 60%, 65%, 70%, 75%, 80%, 85%, 90%, 95%, 98%, 99% or more amino acid sequence identity to a polypeptide as represented by SEQ ID NO: 348.

Alternatively or additionally, a "PHD-zf polypeptide" as defined herein refers to any polypeptide having in increasing order of preference at least 50%, 55%, 60%, 65%, 70%, 75%, 80%, 85%, 90%, 95%, 98%, 99% or more amino acid sequence identity to any of the polypeptide sequences given in Table A4 herein encoding such a PHD-zf polypeptide. The nucleic acid sequence to be introduced into a plant (and therefore useful in performing the methods of the invention) is any nucleic acid sequence encoding the type of polypeptide, which will now be described, hereafter also named "PHD-zf Concerning REF/ALY polypeptides, a ny reference hereinafter to a "protein useful in the methods of the invention" is taken to mean a REF/ALY polypeptide as defined herein. Any reference hereinafter to a "nucleic acid useful in the methods of the invention" is taken to mean a nucleic acid capable of encoding such a REF/ALY polypeptide. The nucleic acid to be introduced into a plant (and therefore useful in performing the methods of the invention) is any nucleic acid encoding the type of protein which will now be described, hereafter also named "REF/ALY nucleic acid" or "REF/ALY gene".

A "REF/ALY polypeptide" as defined herein refers to any polypeptide comprising an RRM (RNA Recognition Motif) domain. Additionally a "REF/ALY polypeptide comprises one or more protein motifs having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to a conserved protein motif selected from:
  (i) Motif 10 as represented by SEQ ID NO: 540 (SAEDLDADLDKYHS)
  (ii) Motif 11 as represented by SEQ ID NO: 541 (LDMSLDDMIAKNRK)
  (iii) Motif 12 as represented by SEQ ID NO: 542 (KAPESTWGHDMF)
  (iv) Motif 13 as represented by SEQ ID NO: 543 (WQHDMY)
  (v) Motif 14 as represented by SEQ ID NO: 544 (KLYISNLDYGV)

Motifs 10, 11, 12, 13 and 14 further comprise a sequence as represented by SEQ ID NO: 540, 541, 542, 543, and 544 respectively in which any amino acid residue is substituted by a conservative amino acid residues according to Table 1.

Examples of variants of conserved motifs 10 and 11 as found in REF/ALY polypeptides useful in the methods of the invention are given in Table 3.

TABLE 3

| REF/ALY polypeptide SEQ ID NO: | Motif 10 | Motif 11 |
|---|---|---|
| 498 | SAEDLDADLDKYHSGDM | LDMSLDDMIAKNRK |
| 512 | SAEELDAELEKYHAQGA | IDMSLDDIIKNNKK |
| 530 | SAEELDAELEKYHAQGT | |
| 534 | SAEELDAELEKYHAQGT | LDMTLEDIIKNNKK |
| 520 | SAEELDADLEKYHADAM | LDMTLDDIIKNNKK |
| 536 | STEELDADLEKYHADAM | LDMTLDDIIKNNKK |
| 538 | KNSMLIWRSIMLMRCRP | LDMTLDDIIKNNKK |
| 506 | ADDLDADLEKYHAEAM | MDMSLDDIIKNNKK |
| 516 | SAEDLDAELEKYHAEAM | LDMTLEDIIKNNKK |
| 508 | AEDLDADLEKYHAEAM | LDMTLEDIIKNNKK |
| 518 | AEDLDADLMKYHTEAM | LDVSLDDLIKRNKS |
| 526 | AEDLDADLMKYHTEAM | LDMTLDDLIKKNKT |
| 500 | TAEDLDADLEKYHAEAM | LDVSLDDLIKRNKS |
| 502 | AEDLDADLEKYHSEAM | LDMSLDDIIENNRK |
| 522 | AEDLDADLEKYHSEAM | LDMTLDDIIKNNKK |

In a preferred embodiment of the invention Motif 10 is located at the C-terminus and Motif 11 at the N-terminus of the REF/ALY polypeptide useful in the methods of the invention.

In another embodiment of the invention the REF/ALY polypeptide comprise two glycine rich regions comprising a varying number of Arginine-Glycine or Glycine-Arginine (GR or RG) dipeptide. Preferably the glycine rich regions are flanking the RRM domain. Typically the number of GR or RG dipeptides comprised in REF/ALY polypeptide is 1, 2, 3, 4, 5, 6, 7, 8, 9, 10, 11, 12, 13, 14, 15, 16, 17, 18, 19 or 20.

RRM domains are well known in the art and consist of around 80-90 amino acids; they have a structure consisting of four strands and two helices arranged in an alpha/beta sandwich, with a third helix sometimes being present during RNA binding. RRM domain-containing proteins have a modular structure. RRM domains may be identified using SMART (a Simple Modular Architecture Research Tool: Identification of signaling domains, Schultz et al. PNAS, 95, 5857-5864 (1998), See also Letunic et al., Recent improvements to the SMART domain-based sequence annotation resource (Nucleic Acids Res. 30(1), 242-244) or alternatively RRM domains present in a polypeptide sequence may be found by scanning databases such as Interpro or pfam. The Examples Section provides the results obtained when scanning Interpro and Pfam databases with SEQ ID NO: 498.

The REF/ALY polypeptides useful in the methods of the invention comprise a domain typically located in the central part of the protein and having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the RRM domain of SEQ ID NO: 498 as represented by SEQ ID NO: 539 (KLYISNLDYGVMNEDIKELFAE-VGELKRYTVHFDRSGRSKGTAEVVYSRRG DALAAVKKYNDVQLDGKPMKIE).

Alternatively, the homologue of a REF/ALY protein useful in the methods of the invention has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 498, provided that the homologous protein comprises the conserved motifs as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered.

Preferably, the polypeptide sequence which when used in the construction of a phylogenetic tree, such as the one depicted in FIG. 16, clusters with the group 1 of REF/ALY polypeptides comprising the amino acid sequence represented by SEQ ID NO: 498 rather than with any other group.

The terms "domain", "signature" and "motif" are defined in the "definitions" section herein. Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-

318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32:D134-D137, (2004)), or Pfam (Bateman et al., Nucleic Acids Research 30(1): 276-280 (2002)). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788 (2003)). Domains or motifs may also be identified using routine techniques, such as by sequence alignment.

Concerning Znf A20/AN1 polypeptides, analysis of the polypeptide sequence of SEQ ID NO: 213 is presented below in The Examples Section herein. For example, a Znf A20/AN1 polypeptide as represented by SEQ ID NO: 213 or by SEQ ID NO: 215, comprises at least one A20-type zinc finger domain with an InterPro accession IPR002653 (ProSite accession PS51036) and at least one AN1-type zinc finger domain with an InterPro accession IPR000058 (ProSite accession PS51039) in the InterPro domain database. Domains may also be identified using routine techniques, such as by sequence alignment. An alignment of the A20-type zinc finger domain of the polypeptides of Table A3 herein, is shown in FIG. 9, and alignment of the AN1-type zinc finger domain of the polypeptides of Table A3 herein, is shown in same FIG. 9. Such alignments are useful for identifying the most conserved amino acids between the Znf A20/AN1 polypeptides, such as the A20-type zinc finger domain amino acid residues and its conserved Cys residues, or the AN1 type zinc finger domain amino acid residues and its conserved Cys and His residues.

Concerning PHD-zf polypeptides, an alignment of the polypeptides of Table A4 herein, is shown in FIG. 13. Such alignments are useful for identifying the most conserved domains or motifs between the PHD-zf polypeptides as defined herein. One such domain is a Conserved Domain, boxed in FIG. 13, and as represented by SEQ ID NO: 491. Another is a PHD-zf domain with the consensus sequence $CXXC_{8-21}CXXC_4HXXC_{12-46}CXXC$, where the conserved C (Cys) and H (His) are easily identified (see FIG. 13).

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith T F, Waterman M S (1981) J. Mol. Biol 147(1); 195-7).

Concerning Znf A20/AN1 polypeptides, outside of the A20-type zinc finger domain and the AN1-type zinc finger domain, Znf A20/AN1 polypeptides reputedly have low amino acid sequence identity. The Examples Section herein describes in Table B the percentage identity between the Znf A20/AN1 polypeptide as represented by SEQ ID NO: 213, or by SEQ ID NO: 215, and the Znf A20/AN1 polypeptides listed in Table A, which can be as low as 25% amino acid sequence identity. The percentage identity can be substantially increased if the identity calculation is performed between the A20-type zinc finger domain as represented by SEQ ID NO: 338 comprised in SEQ ID NO: 213, and the A20-type zinc finger domain of the Znf A20/AN1 polypeptides of Table A (boxed in FIG. 9) and the QLQ domains of the polypeptides useful in performing the invention. Similarly, the percentage identity can be substantially increased if the identity calculation is performed between the AN1-type zinc finger domain as represented by SEQ ID NO: 338 and the AN1-type zinc finger domain of the polypeptides useful in performing the invention (boxed in FIG. 9).

Concerning PHD-zf polypeptides, The Examples Section describes in Table B the percentage identity between the PHD-zf polypeptide as represented by SEQ ID NO: 348 and the PHD-zf polypeptides listed in Table A, which can be as low as 50% amino acid sequence identity.

Concerning PHD-zf polypeptides, furthermore, the presence of an E/D rich motif may also readily be identified. Primary amino acid composition (in %) to determine if a polypeptide domain is rich in specific amino acids may be calculated using software programs from the ExPASy server, in particular the ProtParam tool (Gasteiger E et al. (2003) ExPASy: the proteomics server for in-depth protein knowledge and analysis. Nucleic Acids Res 31:3784-3788). The composition of the protein of interest may then be compared to the average amino acid composition (in %) in the Swiss-Prot Protein Sequence data bank. Within this databank, the average Asp (D) and Glu (E) content are of 5.3% and of 6.6% respectively, the combined average being of 11.9%. As defined herein, an E/D rich motif has a combined Asp (D) and Glu (E) content (in % terms) above that found in the average amino acid composition (in % terms) of the proteins in the Swiss-Prot Protein Sequence database. An E/D rich motif may be part of a transcription activation domain. Eukaryotic transcription activation domains have been classified according to their amino acid content, and major categories include acidic, glutamine-rich and proline-rich activation domains (Rutherford et al. (2005) Plant J. 43(5):769-88, and references therein). Alternatively, a conserved E/D rich motif may also be identified simply by eye inspection of a multiple sequence alignment, for example of the polypeptide sequence of Table A4, and as shown in FIG. 13.

PHD-zf polypeptides may additionally comprise a KRAR motif, where K is Lys, R Arg, and A Ala. This motif is located in the last 10 amino acids of the C-terminal end of the polypeptide (see FIG. 13). The presence of the KRAR motif may be identified using methods for the alignment of sequences for comparison as described hereinabove. In some instances, the default parameters may be adjusted to modify the stringency of the search. For example using BLAST, the statistical significance threshold (called "expect" value) for reporting matches against database sequences may be increased to show less stringent matches. This way, short nearly exact matches may be identified.

The task of protein subcellular localisation prediction is important and well studied. Knowing a protein's localisation helps elucidate its function. Experimental methods for protein localization range from immunolocalization to tagging of proteins using green fluorescent protein (GFP) or beta-glucuronidase (GUS). Such methods are accurate although labor-intensive compared with computational methods. Recently much progress has been made in computational prediction of protein localisation from sequence data. Among algorithms well known to a person skilled in the art are available at the ExPASy Proteomics tools hosted by the Swiss Institute for Bioinformatics, for example, PSort, TargetP, ChloroP, LocTree, Predotar, LipoP, MITOPROT, PATS, PTS1, SignalP and others.

Concerning Znf A20/AN1 polypeptides, for example, TargetP predicts a non-chloroplastic, non-mitocondrial, and non-secretory pathway subcellular localisation for a Znf A20/AN1 polypeptide as represented by SEQ ID NO: 213, and described in The Examples Section. Preferred subcellular localisation a Znf A20/AN1 polypeptide as represented by SEQ ID NO: 213 is the cytoplasm and/or the nucleus.

Concerning PHD-zf polypeptides, using the transmembrane prediction software TMHMM, a predicted transmembrane domain is identified in the polypeptides useful in performing the methods of the (see The Examples Section and FIG. 12 herein).

Furthermore, TFL1-like polypeptides when ectopically expressed in *Arabidopsis thaliana* plants have delayed flowering when compared to wild type plants or to control plants; or when expressed in rice plants typically have one or more of the following activities when compared to wild type plants or to control plants: increase in seed yield/seed number under non-stress or under drought stress growth conditions and increase in root biomass. Tools and techniques for measuring the abovementioned activities are well known in the art (Carmona et al. 2007) and further described in the Examples section.

In addition, TFL1-like polypeptides, when expressed in rice according to the methods of the present invention as outlined in the Examples section, give plants having enhanced yield related traits, in particular give any one of increased seed yield, increase seed number and increase harvest index.

Furthermore, R5PI polypeptides typically have D-ribose-5-phosphate isomerase activity. Tools and techniques for measuring D-ribose-5-phosphate isomerase activity are well known in the art Jung et al. 2000).

In addition, R5PI polypeptides, when expressed in rice according to the methods of the present invention as outlined in The Examples Section, give plants having increased on or more yield-related traits selected from root biomass, total weight of seeds per plant, number of filled seeds per plant, number of flowers per panicle, total number of seeds per plant.

Furthermore, Znf A20/AN1 polypeptides useful in the methods of the present invention (at least in their native form) typically, but not necessarily, have transcriptional regulatory activity and capacity to interact with other proteins. DNA-binding activity and protein-protein interactions may readily be determined in vitro or in vivo using techniques well known in the art (for example in Current Protocols in Molecular Biology, Volumes 1 and 2, Ausubel et al. (1994), Current Protocols). For example, the A20 zinc finger domain and the AN1 zinc finger domain of Znf A20/AN1 polypeptides are capable of interacting with each other in vivo in yeast cells, using a yeast two-hybrid protein-protein interaction assay (Kanneganti & Gupta, supra).

REF/ALY polypeptides (at least in their native form) may have nucleic acid binding activity wherein the nucleic acid is preferably ribonucleic acid. Tools and techniques for measuring nucleic acid binding activity are well known in the art. For example, RNA-binding activity may readily be determined in vitro or in vivo using techniques well known in the art. Examples of in vitro assays include: nucleic acid binding assays using North-Western and/or South-Western analysis (Suzuki et al. Plant Cell Physiol. 41(3): 282-288 (2000)); RNA binding assays using UV cross linking; Electrophoretic Mobility Shift Assay for RNA Binding Proteins (Smith, RNA-Protein Interactions—A Practical Approach 1998, University of Cambridge); chromatin immunoprecipitation assay (Suganuma et al. FEBS J. 2005; 272(11):2696-704). Examples of in vivo assays include: TRAP (translational repression assay procedure) (Paraskeva E, Atzberger A, Hentze M W: A translational repression assay procedure (TRAP) for RNA-protein interactions in vivo. PNAS 1998 Feb. 3; 95(3): 951-6.).

Furthermore, REF/ALY polypeptides (at least in their native form) may be able to complement yeast strains defective in Yra1p, a conserved nuclear RNA-binding protein in yeast as described by Strässer K and Hurt E (2000). EMBO J. 19(3):410-20.

Alternatively, REF/ALY polypeptides may be able to interact with the P19 protein of Tomato Bushy Stunt Virus (TBSV). Tools and techniques to assay interaction of REF/ALY polypeptides and the P19 of TBSV have been described by Uhrig et al. 2004, Plant Physiology Vol. 135, pp. 2411-2423.

In addition, REF/ALY polypeptides, when expressed in rice according to the methods of the present invention as outlined in the Examples section, give plants having increased yield related traits, in particular any one or more of increased emergence vigour, increased total seed weight and increased number of filled seeds per plant relative to control plants.

Concerning TFL1-like polypeptides, the present invention is illustrated by transforming plants with the nucleic acid sequence represented by SEQ ID NO: 1 and by SEQ ID NO: 25, encoding the polypeptide sequence of SEQ ID NO: 2 and SEQ ID NO: 26 respectively. However, performance of the invention is not restricted to these sequences; the methods of the invention may advantageously be performed using any TFL1_Like encoding nucleic acid or TFL1-like polypeptide as defined herein.

Examples of nucleic acids encoding TFL1-like polypeptides are given in Table A1 of Example 1 herein. Such nucleic acids are useful in performing the methods of the invention. The amino acid sequences given in Table A1 of Example 1 are example sequences of orthologues and paralogues of the TFL1-like polypeptide represented by SEQ ID NO: 2 and/or 26, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A1 of Example 1) against any sequence database, such as the publicly available NCBI database. BLASTN or TBLASTX (using standard default values) are generally used when starting from a nucleotide sequence, and BLASTP or TBLASTN (using standard default values)

when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 1 or SEQ ID NO: 2, the second BLAST would therefore be against *Arabidopsis thaliana* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning R5PI polypeptides, the present invention is illustrated by transforming plants with the nucleic acid sequence represented by SEQ ID NO: 140, encoding the polypeptide sequence of SEQ ID NO: 141. However, performance of the invention is not restricted to these sequences; the methods of the invention may advantageously be performed using any R5PI-encoding nucleic acid or R5PI polypeptide as defined herein.

Examples of nucleic acids encoding R5PI polypeptides are given in Table A2 of The Examples section herein. Such nucleic acids are useful in performing the methods of the invention. The amino acid sequences given in Table A2 of The Examples section are example sequences of orthologues and paralogues of the R5PI polypeptide represented by SEQ ID NO: 141, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A2 of The Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 140 or SEQ ID NO: 141, the second BLAST would therefore be against *Arabidopsis thaliana* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning Znf A20/AN1 polypeptides, the present invention is illustrated by transforming plants with the nucleic acid sequence represented by SEQ ID NO: 212, or as represented by SEQ ID NO: 214, respectively encoding a Znf A20/AN1 polypeptide sequence of SEQ ID NO: 213, or Znf A20/AN1 polypeptide sequence of SEQ ID NO: 215. However, performance of the invention is not restricted to these sequences; the methods of the invention may advantageously be performed using any nucleic acid sequence encoding a Znf A20/AN1 polypeptide as defined herein.

Examples of nucleic acid sequences encoding Znf A20/AN1 polypeptides are given in Table A3 of Example 1 herein. Such nucleic acid sequences are useful in performing the methods of the invention. The polypeptide sequences given in Table A3 of Example 1 are example sequences of orthologues and paralogues of the Znf A20/AN1 polypeptide represented by SEQ ID NO: 213, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A3 of Example 1) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 212 or SEQ ID NO: 213, the second BLAST would therefore be against *Arabidopsis thaliana* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning PHD-zf polypeptides, the present invention is illustrated by transforming plants with the nucleic acid sequence represented by SEQ ID NO: 347, encoding the PHD-zf polypeptide sequence of SEQ ID NO: 348. However, performance of the invention is not restricted to these sequences; the methods of the invention may advantageously be performed using any nucleic acid sequence encoding a PHD-zf polypeptide as defined herein.

Examples of nucleic acid sequences encoding PHD-zf polypeptides are given in Table A4 of Example 1 herein. Such nucleic acid sequences are useful in performing the methods of the invention. The polypeptide sequences given in Table A4 of Example 1 are example sequences of orthologues and paralogues of the PHD-zf polypeptide represented by SEQ ID NO: 348, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A4 of Example 1) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 347 or SEQ ID NO: 348, the second BLAST would therefore be against *Lycopersicon esculentum* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning REF/ALY polypeptides, the present invention is illustrated by transforming plants with the nucleic acid sequence represented by SEQ ID NO: 497, encoding the polypeptide sequence of SEQ ID NO: 498. However, performance of the invention is not restricted to these sequences; the methods of the invention may advantageously be performed using any REF/ALY-encoding nucleic acid or REF/ALY polypeptide as defined herein.

Examples of nucleic acids encoding REF/ALY polypeptides are given in Table A5 of The Examples section herein. Such nucleic acids are useful in performing the methods of the invention. The amino acid sequences given in Table A5 of The Examples section are example sequences of orthologues and paralogues of the REF/ALY polypeptide represented by SEQ ID NO: 498, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A5 of The Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 497 or SEQ ID NO: 498, the second BLAST would therefore be against *Arabidopsis thaliana* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Concerning R5PI polypeptides, a preferred R5PI nucleic acid useful in the methods of the invention encodes an R5PI polypeptide which is typically (at least in its natural form) expressed on the cytosol of a cell. A further preferred R5PI nucleic acid encodes an R5PI polypeptide which is typically (at least in its natural form) expressed on the chloroplast of a cell, such R5PI nucleic acid being modified to be expressed in the cytosol. Method to specifically express a nucleic acid in a preferred subcellular compartment are well known in the art as for example in Ausubel et al. 1994. For example, cytosolic cellular targeting of protein which is naturally expressed in the chloroplast can be achieved by removal from the chloroplastic targeting signal. On the contrary, a typically cytosolic expressed protein may be expressed in the chloroplast by incorporating in the gene a chloroplast targeting signaling. Methods to identify chloroplast targeting signal, methods to incorporate or to remove such signals from polypeptides are well known in the art.

Nucleic acid variants may also be useful in practising the methods of the invention. Examples of such variants include nucleic acids encoding homologues and derivatives of any one of the amino acid sequences given in Table A1 to A5 of the Examples section, the terms "homologue" and "derivative" being as defined herein. Also useful in the methods of the invention are nucleic acids encoding homologues and derivatives of orthologues or paralogues of any one of the amino acid sequences given in Table A1 to A5 of the Examples section. Homologues and derivatives useful in the methods of the present invention have substantially the same biological and functional activity as the unmodified protein from which they are derived.

Further nucleic acid variants useful in practising the methods of the invention include portions of nucleic acids encoding TFL1-like polypeptides, or R5PI polypeptides, or Znf A20/AN1 polypeptides, or PHD-zf polypeptides, or REF/ALY polypeptides, nucleic acids hybridising to nucleic acids encoding TFL1-like polypeptides, or R5PI polypeptides, or Znf A20/AN1 polypeptides, or PHD-zf polypeptides, or REF/ALY polypeptides, splice variants of nucleic acids encoding TFL1-like polypeptides, or R5PI polypeptides, or Znf A20/AN1 polypeptides, or PHD-zf polypeptides, or REF/ALY polypeptides, allelic variants of nucleic acids encoding TFL1-like polypeptides and variants of nucleic acids encoding TFL1-like polypeptides, or R5PI polypeptides, or Znf A20/AN1 polypeptides, or PHD-zf polypeptides, or REF/ALY polypeptides, obtained by gene shuffling. The terms hybridising sequence, splice variant, allelic variant and gene shuffling are as described herein.

Nucleic acids encoding TFL1-like polypeptides, or R5PI polypeptides, or Znf A20/AN1 polypeptides, or PHD-zf polypeptides, or REF/ALY polypeptides, need not be full-length nucleic acids, since performance of the methods of the invention does not rely on the use of full-length nucleic acid sequences. According to the present invention, there is provided a method for enhancing yield-related traits in plants, comprising introducing and expressing in a plant a portion of any one of the nucleic acid sequences given in Table A1 to A5 of the Examples section, or a portion of a nucleic acid encoding an orthologue, paralogue or homologue of any of the amino acid sequences given in Table A1 to A5 of the Examples section.

A portion of a nucleic acid may be prepared, for example, by making one or more deletions to the nucleic acid. The portions may be used in isolated form or they may be fused to other coding (or non-coding) sequences in order to, for example, produce a protein that combines several activities. When fused to other coding sequences, the resultant polypeptide produced upon translation may be bigger than that predicted for the protein portion.

Concerning TFL1-like polypeptides, portions useful in the methods of the invention, encode a TFL1-like polypeptide as defined herein, and have substantially the same biological activity as the amino acid sequences given in Table A1 of the Examples section. Preferably, the portion is a portion of any one of the nucleic acids given in Table A1 of the Examples section, or is a portion of a nucleic acid encoding an orthologue or paralogue of any one of the amino acid sequences given in Table A1 of the Examples section. Preferably the portion is at least 100, 150, 200, 250, 300, 350 400, 450 consecutive nucleotides in length, the consecutive nucleotides being of any one of the nucleic acid sequences given in Table A1 of the Examples section, or of a nucleic acid encoding an orthologue or paralogue of any one of the amino acid sequences given in Table A1 of the Examples section. Most preferably the portion is a portion of the nucleic acid of SEQ ID NO: 1. Preferably, the portion encodes a fragment of an amino acid sequence which, when used in the construction of a phylogenetic tree, such as the one depicted in FIG. 2 of Carmona et al. 2007, clusters with the group of TFL1-like polypeptides comprising the amino acid sequence represented by SEQ ID NO: 2 rather than with any other group. Further preferably the portion sequence clusters within the clade comprising the *Arabidopsis* ATC, the *Anthirrinum* CEN, the *Lycopersicum* SP, the *Nicotiana* CET2 and the Vitis VvTFL1A polypeptide.

Concerning R5PI polypeptides, portions useful in the methods of the invention, encode a R5PI polypeptide as defined herein, and have substantially the same biological activity as the amino acid sequences given in Table A2 of The Examples section. Preferably, the portion is a portion of any one of the nucleic acids given in Table A2 of The Examples section, or is a portion of a nucleic acid encoding an orthologue or paralogue of any one of the amino acid sequences given in Table A2 of The Examples section. Preferably the portion is at least 500, 550, 600, 650, 700, 750, 800, 850, 900, 950, 1000 consecutive nucleotides in length, the consecutive nucleotides being of any one of the nucleic acid sequences given in Table A2 of The Examples section, or of a nucleic acid encoding an orthologue or paralogue of any one of the amino acid sequences given in Table A2 of The Examples section. Most preferably the portion is a portion of the nucleic acid of SEQ ID NO: 140. Preferably, the portion encodes a fragment of an amino acid sequence which, when used in the construction of a phylogenetic tree, such as the one depicted in FIG. 5, clusters with group I comprising the amino acid sequence represented by SEQ ID NO: 141 rather than with any other group.

Concerning Znf A20/AN1 polypeptides, portions useful in the methods of the invention, encode a Znf A20/AN1 polypeptide as defined herein, and have substantially the same biological activity as the polypeptide sequences given in Table A3 of Example 1. Preferably, the portion is a portion of any one of the nucleic acid sequences given in Table A3 of Example 1, or is a portion of a nucleic acid sequence encoding an orthologue or paralogue of any one of the polypeptide sequences given in Table A3 of Example 1. Preferably the portion is, in increasing order of preference at least 200, 250, 300, 350, 400, 450, 500, or more consecutive nucleotides in length, the consecutive nucleotides being of any one of the nucleic acid sequences given in Table A3 of Example 1, or of a nucleic acid sequence encoding an orthologue or paralogue of any one of the polypeptide sequences given in Table A3 of Example 1. Preferably, the portion is a portion of a nucleic sequence encoding a polypeptide sequence comprising (i) a domain having at least 40%, 45%, 50%, 55%, 60%, 65%, 70%, 75%, 80%, 85%, 90%, 95%, 98%, 99% or more amino acid sequence identity to an A20-type zinc finger domain as represented by SEQ ID NO: 338, or by SEQ ID NO: 339; and (ii) a domain having at least 40%, 45%, 50%, 55%, 60%, 65%, 70%, 75%, 80%, 85%, 90%, 95%, 98%, 99% or more amino acid sequence identity to an AN1-type zinc finger domain as represented by SEQ ID NO: 340, or by SEQ ID NO: 341. Most preferably the portion is a portion of the nucleic acid sequence of SEQ ID NO: 212 or of SEQ ID NO: 214.

Concerning PHD-zf polypeptides, portions useful in the methods of the invention, encode a PHD-zf polypeptide as defined herein, and have substantially the same biological activity as the polypeptide sequences given in Table A4 of Example 1. Preferably, the portion is a portion of any one of the nucleic acid sequences given in Table A4 of Example 1, or is a portion of a nucleic acid sequence encoding an orthologue or paralogue of any one of the polypeptide sequences given in Table A4 of Example 1. Preferably the portion is, in increasing order of preference at least 400, 450, 500, 550, 600, 650, 700, 750, or more consecutive nucleotides in length, the consecutive nucleotides being of any one of the nucleic acid sequences given in Table A4 of Example 1, or of a nucleic acid sequence encoding an orthologue or paralogue of any one of the polypeptide sequences given in Table A4 of Example 1. Preferably, the portion is a portion of a nucleic sequence encoding a polypeptide sequence having in increasing order of preference at least 50%, 55%, 60%, 65%, 70%, 75%, 80%, 85%, 90%, 95%, 98%, 99% or more amino acid sequence identity to the PHD-zf polypeptide as represented by SEQ ID NO: 348 or to any of the polypeptide sequences given in Table A4 herein. Most preferably, the portion is a portion of the nucleic acid sequence of SEQ ID NO: 347.

Concerning REF/ALY polypeptides, portions useful in the methods of the invention, encode a REF/ALY polypeptide as defined herein, and have substantially the same biological activity as the amino acid sequences given in Table A5 of the Examples section. Preferably, the portion is a portion of any one of the nucleic acids given in Table A5 of The Examples section, or is a portion of a nucleic acid encoding an orthologue or paralogue of any one of the amino acid sequences given in Table A5 of the Examples section. Preferably the portion is at least 300, 350, 400, 450, 500, 550, 600, 650, 700, 750, 800, 850, 900, 950, 1000 consecutive nucleotides in length, the consecutive nucleotides being of any one of the nucleic acid sequences given in Table A5 of The Examples section, or of a nucleic acid encoding an orthologue or paralogue of any one of the amino acid sequences given in Table A5 of the Examples section. Most preferably the portion is a portion of the nucleic acid of SEQ ID NO: 497. Preferably, the portion encodes a fragment of an amino acid sequence which, when used in the construction of a phylogenetic tree, such as the one in FIG. 2, clusters with the group 1 of REF/ALY polypeptides comprising the amino acid sequence represented by SEQ ID NO: 498 rather than with any other group.

Another nucleic acid variant useful in the methods of the invention is a nucleic acid capable of hybridising, under reduced stringency conditions, preferably under stringent conditions, with a nucleic acid encoding a TFL1-like polypeptide, or an R5PI polypeptide, or a Znf A20/AN1 polypeptide, or a PHD-zf polypeptide, or an REF/ALY polypeptide, as defined herein, or with a portion as defined herein.

According to the present invention, there is provided a method for enhancing yield-related traits in plants, comprising introducing and expressing in a plant a nucleic acid capable of hybridizing to any one of the nucleic acids given in Table A1 to A5 of the Examples section, or comprising introducing and expressing in a plant a nucleic acid capable of hybridising to a nucleic acid encoding an orthologue, paralogue or homologue of any of the nucleic acid sequences given in Table A1 to A5 of the Examples section.

Concerning TFL1-like polypeptides, hybridising sequences useful in the methods of the invention encode a TFL1-like polypeptide as defined herein, having substantially the same biological activity as the amino acid sequences given in Table A1 of the Examples section. Preferably, the hybridising sequence is capable of hybridising to the complement of any one of the nucleic acids given in Table A1 of the Examples section, or to a portion of any of these sequences, a portion being as defined above, or the hybridising sequence is capable of hybridising to the complement of a nucleic acid encoding an orthologue or paralogue of any one of the amino acid sequences given in Table A1 of the Examples section. Most preferably, the hybridising sequence is capable of hybridising to the complement of a nucleic acid as represented by SEQ ID NO: 1 or to SEQ ID NO: 25 or to a portion thereof.

Concerning TFL1-like polypeptides, preferably, the hybridising sequence encodes a polypeptide with an amino acid sequence which, when full-length and used in the construction of a phylogenetic tree, such as the one depicted in FIG. 2 of Carmona et al. 2007, clusters with the group of TFL1-like polypeptides comprising the amino acid sequence represented by SEQ ID NO: 2 rather than with any other group. Further preferably the polypeptide sequence clusters within the clade comprising the *Arabidopsis* ATC, the *Anthirrinum* CEN, the *Lycopersicum* SP, the *Nicotiana* CET2 and the *Vitis* VvTFL1A polypeptide or alternatively when used in the construction of a phylogenetic tree, such as the one depicted in FIG. 2 of Igasaki et al. 2008 (Plant Cell Physiol. 49(3): 291-300,) clusters in the TFL1 clade, more preferably in the BFT (Brother of FT) clade, even more preferably with BFT. FIG. 2 of Igasaki et al. 2008 is depicted in FIG. 2B.

Concerning R5PI polypeptides, hybridising sequences useful in the methods of the invention encode a R5PI polypeptide as defined herein, having substantially the same biological activity as the amino acid sequences given in Table A2 of The Examples section. Preferably, the hybridising sequence is capable of hybridising to the complement of any one of the nucleic acids given in Table A2 of The Examples section, or to a portion of any of these sequences, a portion being as defined above, or the hybridising sequence is capable of hybridising to the complement of a nucleic acid encoding an orthologue or paralogue of any one of the amino acid sequences given in Table A2 of The Examples section. Most preferably, the hybridising sequence is capable of hybridising to the complement of a nucleic acid as represented by SEQ ID NO: 140 or to a portion thereof.

Concerning R5PI polypeptides, preferably, the hybridising sequence encodes a polypeptide with an amino acid sequence which, when full-length and used in the construction of a phylogenetic tree, such as the one depicted in FIG. 5, clusters with group I comprising the amino acid sequence represented by SEQ ID NO: 141 rather than with any other group.

Concerning Znf A20/AN1 polypeptides, hybridising sequences useful in the methods of the invention encode a Znf A20/AN1 polypeptide as defined herein, and have substantially the same biological activity as the polypeptide sequences given in Table A3 of Example 1. Preferably, the hybridising sequence is capable of hybridising to any one of the nucleic acid sequences given in Table A3 of Example 1, or to a portion of any of these sequences, a portion being as defined above, or wherein the hybridising sequence is capable of hybridising to a nucleic acid sequence encoding an orthologue or paralogue of any one of the polypeptide sequences given in Table A3 of Example 1. Preferably, the hybridising sequence is capable of hybridising to a nucleic acid sequence encoding a polypeptide sequence comprising (i) a domain having at least 40%, 45%, 50%, 55%, 60%, 65%, 70%, 75%, 80%, 85%, 90%, 95%, 98%, 99% or more amino acid sequence identity to an A20-type zinc finger domain as represented by SEQ ID NO: 338, or by SEQ ID NO: 339; and (ii) a domain having at least 40%, 45%, 50%, 55%, 60%, 65%, 70%, 75%, 80%, 85%, 90%, 95%, 98%, 99% or more amino acid sequence identity to an AN1-type zinc finger domain as represented by SEQ ID NO: 340, or by SEQ ID NO: 341. Most preferably, the hybridising sequence is capable of hybridising to a nucleic acid sequence as represented by SEQ ID NO: 212 or to a portion thereof or by SEQ ID NO: 214 or to a portion thereof.

Concerning PHD-zf polypeptides, hybridising sequences useful in the methods of the invention encode a PHD-zf polypeptide as defined herein, and have substantially the same biological activity as the polypeptide sequences given in Table A4 of Example 1. Preferably, the hybridising sequence is capable of hybridising to any one of the nucleic acid sequences given in Table A4 of Example 1, or to a complement thereof, or to a portion of any of these sequences, a portion being as defined above, or wherein the hybridising sequence is capable of hybridising to a nucleic acid sequence encoding an orthologue or paralogue of any one of the polypeptide sequences given in Table A4 of Example 1, or to a complement thereof. Preferably, the hybridising sequence is capable of hybridising to a nucleic acid sequence encoding a polypeptide sequence having in increasing order of preference at least 50%, 55%, 60%, 65%, 70%, 75%, 80%, 85%, 90%, 95%, 98%, 99% or more amino acid sequence identity to the PHD-zf polypeptide as represented by SEQ ID NO: 348 or to any of the polypeptide sequences given in Table A4 herein. Most preferably, the hybridising sequence is capable of hybridising to a nucleic acid sequence as represented by SEQ ID NO: 347 or to a portion thereof.

Concerning REF/ALY polypeptides, hybridising sequences useful in the methods of the invention encode a REF/ALY polypeptide as defined herein, having substantially the same biological activity as the amino acid sequences given in Table A5 of The Examples section. Preferably, the hybridising sequence is capable of hybridising to the complement of any one of the nucleic acids given in Table A5 of The Examples section, or to a portion of any of these sequences, a portion being as defined above, or the hybridising sequence is capable of hybridising to the complement of a nucleic acid encoding an orthologue or paralogue of any one of the amino acid sequences given in Table A5 of The Examples section. Most preferably, the hybridising sequence is capable of hybridising to the complement of a nucleic acid as represented by SEQ ID NO: 497 or to a portion thereof.

Preferably, the hybridising sequence encodes a polypeptide with an amino acid sequence which, when full-length and used in the construction of a phylogenetic tree, such as the one depicted in FIG. 16, clusters with the group 1 of REF/ALY polypeptides comprising the amino acid sequence represented by SEQ ID NO: 498 rather than with any other group.

Another nucleic acid variant useful in the methods of the invention is a splice variant encoding a TFL1-like polypeptide, or an R5PI polypeptide, or a Znf A20/AN1 polypeptide, or a PHD-zf polypeptide, or an REF/ALY polypeptide, as defined hereinabove, a splice variant being as defined herein.

According to the present invention, there is provided a method for enhancing yield-related traits in plants, comprising introducing and expressing in a plant a splice variant of any one of the nucleic acid sequences given in Table A1 to A5 of the Examples section, or a splice variant of a nucleic acid encoding an orthologue, paralogue or homologue of any of the amino acid sequences given in Table A1 to A5 of the Examples section.

Concerning TFL1-like polypeptides, preferred splice variants are splice variants of a nucleic acid represented by SEQ ID NO: 1, or a splice variant of a nucleic acid encoding an orthologue or paralogue of SEQ ID NO: 2. Preferably, the amino acid sequence encoded by the splice variant, when used in the construction of a phylogenetic tree, such as the one depicted in FIG. 2 of Carmona et al. 2007, clusters with the group of TFL1-like polypeptides comprising the amino acid sequence represented by SEQ ID NO: 2 rather than with any other group. Further preferably the spliced variant sequence clusters within the clade comprising the *Arabidopsis* ATC, the *Anthirrinum* CEN, the *Lycopersicum* SP, the *Nicotiana* CET2 and the Vitis VvTFL1A polypeptide or alternatively when used in the construction of a phylogenetic tree, such as the one depicted in FIG. 2 of Igasaki et al. 2008 (Plant Cell Physiol. 49(3): 291-300,) clusters in the TFL1 clade, more preferably in the BFT (Brother of FT) clade, even more preferably with BFT. FIG. 2 of Igasaki et al. 2008 is depicted in FIG. 2B.

Concerning R5PI polypeptides, preferred splice variants are splice variants of a nucleic acid represented by SEQ ID NO: 140, or a splice variant of a nucleic acid encoding an orthologue or paralogue of SEQ ID NO: 141. Preferably, the amino acid sequence encoded by the splice variant, when used in the construction of a phylogenetic tree, such as the one depicted in FIG. 5, clusters with group I comprising the amino acid sequence represented by SEQ ID NO: 141 rather than with any other group.

Concerning Znf A20/AN1 polypeptides, preferred splice variants are splice variants of a nucleic acid sequence represented by SEQ ID NO: 212 or by SEQ ID NO: 214, or a splice variant of a nucleic acid sequence encoding an orthologue or paralogue of SEQ ID NO: 213 or of SEQ ID NO: 215. Preferably, the splice variant is a splice variant of a nucleic acid sequence encoding a polypeptide sequence comprising (i) a domain having at least 40%, 45%, 50%, 55%, 60%, 65%, 70%, 75%, 80%, 85%, 90%, 95%, 98%, 99% or more amino acid sequence identity to an A20-type zinc finger domain as represented by SEQ ID NO: 338, or by SEQ ID NO: 339; and (ii) a domain having at least 40%, 45%, 50%, 55%, 60%, 65%, 70%, 75%, 80%, 85%, 90%, 95%, 98%, 99% or more amino acid sequence identity to an AN1-type zinc finger domain as represented by SEQ ID NO: 340, or by SEQ ID NO: 341.

Concerning PHD-zf polypeptides, preferred splice variants are splice variants of a nucleic acid sequence represented by SEQ ID NO: 347, or a splice variant of a nucleic acid sequence encoding an orthologue or paralogue of SEQ ID NO: 348. Preferably, the splice variant is a splice variant of a nucleic acid sequence encoding a polypeptide sequence having in increasing order of preference at least 50%, 55%, 60%, 65%, 70%, 75%, 80%, 85%, 90%, 95%, 98%, 99% or more amino acid sequence identity to the PHD-zf polypeptide as represented by SEQ ID NO: 348 or to any of the polypeptide sequences given in Table A4 herein.

Concerning REF/ALY polypeptides, preferred splice variants are splice variants of a nucleic acid represented by SEQ ID NO: 497, or a splice variant of a nucleic acid encoding an orthologue or paralogue of SEQ ID NO: 498. Preferably, the amino acid sequence encoded by the splice variant, when used in the construction of a phylogenetic tree, such as the one depicted in FIG. 16, clusters with the group 1 of REF/ALY polypeptides comprising the amino acid sequence represented by SEQ ID NO: 498 rather than with any other group.

Another nucleic acid variant useful in performing the methods of the invention is an allelic variant of a nucleic acid encoding a TFL1-like polypeptide, or an R5PI polypeptide, or a Znf A20/AN1 polypeptide, or a PHD-zf polypeptide, or an REF/ALY polypeptide, as defined hereinabove, an allelic variant being as defined herein.

According to the present invention, there is provided a method for enhancing yield-related traits in plants, comprising introducing and expressing in a plant an allelic variant of any one of the nucleic acids given in Table A1 to A5 of the Examples section, or comprising introducing and expressing in a plant an allelic variant of a nucleic acid encoding an orthologue, paralogue or homologue of any of the amino acid sequences given in Table A1 to A5 of the Examples section.

Concerning TFL1-like polypeptides, the polypeptides encoded by allelic variants useful in the methods of the present invention have substantially the same biological activity as the TFL1-like polypeptide of SEQ ID NO: 2 and any of the amino acids depicted in Table A1 of the Examples section. Allelic variants exist in nature, and encompassed within the methods of the present invention is the use of these natural alleles. Preferably, the allelic variant is an allelic variant of SEQ ID NO: 1 or an allelic variant of a nucleic acid encoding an orthologue or paralogue of SEQ ID NO: 2. Preferably, the amino acid sequence encoded by the allelic variant, when used in the construction of a phylogenetic tree, such as the one depicted in FIG. 2 of Carmona et al. 2007, clusters with the group of TFL1-like polypeptides comprising the amino acid sequence represented by SEQ ID NO: 2 rather than with any other group. Further preferably the allelic variant sequence clusters within the clade comprising the *Arabidopsis* ATC, the *Anthirrinum* CEN, the *Lycopersicum* SP, the *Nicotiana* CET2 and the Vitis VvTFL1A polypeptide or alternatively when used in the construction of a phylogenetic tree, such as the one depicted in FIG. 2 of Igasaki et al. 2008 (Plant Cell Physiol. 49(3): 291-300,) clusters in the TFL1 clade, more preferably in the BFT (Brother of FT) clade, even more preferably with BFT. FIG. 2 of Igasaki et al. 2008 is depicted in FIG. 2B.

Concerning R5PI polypeptides, the polypeptides encoded by allelic variants useful in the methods of the present invention have substantially the same biological activity as the R5PI polypeptide of SEQ ID NO: 141 and any of the amino acids depicted in Table A2 of The Examples section. Allelic variants exist in nature, and encompassed within the methods of the present invention is the use of these natural alleles. Preferably, the allelic variant is an allelic variant of SEQ ID NO: 140 or an allelic variant of a nucleic acid encoding an orthologue or paralogue of SEQ ID NO: 141. Preferably, the amino acid sequence encoded by the allelic variant, when used in the construction of a phylogenetic tree, such as the one depicted in FIG. 5, clusters with group I comprising the amino acid sequence represented by SEQ ID NO: 141 rather than with any other group.

Concerning Znf A20/AN1 polypeptides, the allelic variants useful in the methods of the present invention have substantially the same biological activity as the Znf A20/AN1 polypeptide of SEQ ID NO: 213 or of SEQ ID NO: 215 and any of the polypeptide sequences depicted in Table A3 of Example 1. Allelic variants exist in nature, and encompassed within the methods of the present invention is the use of these natural alleles. Preferably, the allelic variant is an allelic variant of SEQ ID NO: 212 or of SEQ ID NO: 214, or an allelic variant of a nucleic acid sequence encoding an orthologue or paralogue of SEQ ID NO: 213. Preferably, the allelic variant is an allelic variant of a polypeptide sequence comprising (i) a domain having at least 40%, 45%, 50%, 55%, 60%, 65%, 70%, 75%, 80%, 85%, 90%, 95%, 98%, 99% or more amino acid sequence identity to an A20-type zinc finger domain as represented by SEQ ID NO: 338, or by SEQ ID NO: 339; and (ii) a domain having at least 40%, 45%, 50%, 55%, 60%, 65%, 70%, 75%, 80%, 85%, 90%, 95%, 98%, 99% or more amino acid sequence identity to an AN1-type zinc finger domain as represented by SEQ ID NO: 340, or by SEQ ID NO: 341.

Concerning PHD-zf polypeptides, the allelic variants useful in the methods of the present invention have substantially the same biological activity as the PHD-zf polypeptide of SEQ ID NO: 348 and any of the polypeptide sequences depicted in Table A4 of Example 1. Allelic variants exist in nature, and encompassed within the methods of the present invention is the use of these natural alleles. Preferably, the allelic variant is an allelic variant of SEQ ID NO: 347 or an allelic variant of a nucleic acid sequence encoding an orthologue or paralogue of SEQ ID NO: 348. Preferably, the allelic variant is an allelic variant of a polypeptide sequence having in increasing order of preference at least 50%, 55%, 60%, 65%, 70%, 75%, 80%, 85%, 90%, 95%, 98%, 99% or more amino acid sequence identity to the PHD-zf polypeptide as represented by SEQ ID NO: 348 or to any of the polypeptide sequences given in Table A4 herein.

Concerning REF/ALY polypeptides, the polypeptides encoded by allelic variants useful in the methods of the present invention have substantially the same biological activity as the REF/ALY polypeptide of SEQ ID NO: 498 and any of the amino acids depicted in Table A5 of The Examples section. Allelic variants exist in nature, and encompassed within the methods of the present invention is the use of these natural alleles. Preferably, the allelic variant is an allelic variant of SEQ ID NO: 497 or an allelic variant of a nucleic acid encoding an orthologue or paralogue of SEQ ID NO: 498. Preferably, the amino acid sequence encoded by the allelic variant, when used in the construction of a phylogenetic tree, such as the one depicted in FIG. 16, clusters with the group 1 of REF/ALY polypeptides comprising the amino acid sequence represented by SEQ ID NO: 498 rather than with any other group.

Gene shuffling or directed evolution may also be used to generate variants of nucleic acids encoding TFL1-like polypeptides, or R5PI polypeptides, or Znf A20/AN1 polypeptides, or PHD-zf polypeptides, or REF/ALY polypeptides, as defined above; the term "gene shuffling" being as defined herein.

Concerning TFL1-like polypeptides, or R5PI polypeptides, or Znf A20/AN1 polypeptides, or REF/ALY polypeptides, according to the present invention, there is provided a method for enhancing yield-related traits in plants, comprising introducing and expressing in a plant a variant of any one of the nucleic acid sequences given in Table A1, or Table A2, or Table A3, or Table A5 of the Examples section, or comprising introducing and expressing in a plant a variant of a nucleic acid encoding an orthologue, paralogue or homologue of any of the amino acid sequences given in Table A1, or Table A2, or Table A3, or Table A5 of the Examples section, which variant nucleic acid is obtained by gene shuffling.

Concerning PHD-zf polypeptides, according to the present invention, there is provided a method for increasing seed yield-related traits, comprising introducing and expressing in a plant, a variant of any one of the nucleic acid sequences given in Table A4 of Example 1, or comprising introducing and expressing in a plant a variant of a nucleic acid sequence encoding an orthologue, paralogue or homologue of any of the polypeptide sequences given in Table A4 of Example 1, which variant nucleic acid sequence is obtained by gene shuffling.

Concerning TFL1-like polypeptides, preferably, the amino acid sequence encoded by the variant nucleic acid obtained by gene shuffling, when used in the construction of a phylogenetic tree, such as the one depicted in FIG. 2 of Carmona et al. 2007, clusters with the group of TFL1-like polypeptides comprising the amino acid sequence represented by SEQ ID NO: 2 rather than with any other group. Further preferably the polypeptide sequence clusters within the clade comprising the Arabidopsis ATC, the Anthirrinum CEN, the Lycopersicum SP, the Nicotiana CET2 and the Vitis VvTFL1A polypeptide or alternatively when used in the construction of a phylogenetic tree, such as the one depicted in FIG. 2 of Igasaki et al. 2008 (Plant Cell Physiol. 49(3): 291-300,) clusters in the TFL1 clade, more preferably in the BFT (Brother of FT) clade, even more preferably with BFT. FIG. 2 of Igasaki et al. 2008 is depicted in FIG. 2B.

Concerning R5PI polypeptides, preferably, the amino acid sequence encoded by the variant nucleic acid obtained by gene shuffling, when used in the construction of a phylogenetic tree such as the one depicted in FIG. 5, clusters with group I comprising the amino acid sequence represented by SEQ ID NO: 141 rather than with any other group.

Concerning Znf A20/AN1 polypeptides, preferably, the variant nucleic acid sequence obtained by gene shuffling encodes a polypeptide sequence comprising: (i) a domain having at least 40%, 45%, 50%, 55%, 60%, 65%, 70%, 75%, 80%, 85%, 90%, 95%, 98%, 99% or more amino acid sequence identity to an A20-type zinc finger domain as represented by SEQ ID NO: 338, or by SEQ ID NO: 339; and (ii) a domain having at least 40%, 45%, 50%, 55%, 60%, 65%, 70%, 75%, 80%, 85%, 90%, 95%, 98%, 99% or more amino acid sequence identity to an AN1-type zinc finger domain as represented by SEQ ID NO: 340, or by SEQ ID NO: 341.

Concerning PHD-zf polypeptides, preferably, the variant nucleic acid sequence obtained by gene shuffling encodes a polypeptide sequence having in increasing order of preference at least 50%, 55%, 60%, 65%, 70%, 75%, 80%, 85%, 90%, 95%, 98%, 99%, or more amino acid sequence identity to the PHD-zf polypeptide as represented by SEQ ID NO: 348 or to any of the polypeptide sequences given in Table A4 herein.

Concerning REF/ALY polypeptides, preferably, the amino acid sequence encoded by the variant nucleic acid obtained by gene shuffling, when used in the construction of a phylogenetic tree such as the one depicted in FIG. 16, clusters with the group 1 of REF/ALY polypeptides comprising the amino acid sequence represented by SEQ ID NO: 498 rather than with any other group.

Furthermore, nucleic acid variants may also be obtained by site-directed mutagenesis. Several methods are available to achieve site-directed mutagenesis, the most common being PCR based methods (Current Protocols in Molecular Biology. Wiley Eds.).

Nucleic acids encoding TFL1-like polypeptides may be derived from any natural or artificial source. The nucleic acid may be modified from its native form in composition and/or genomic environment through deliberate human manipulation. Preferably the TFL1-like polypeptide-encoding nucleic acid is from a plant, more preferably from a heterologous plant, further preferably from a dicotyledonous plant, more preferably from the family Brassicaceae, most preferably the nucleic acid is from *Arabidopsis thaliana*.

Advantageously, the present invention provides hitherto unknown TFL1-like nucleic acid and polypeptide sequences.

According to a further embodiment of the present invention, there is provided an isolated nucleic acid molecule comprising:
(i) a nucleic acid represented by SEQ ID NO: 11, SEQ ID NO: 13, SEQ ID NO: 31 or SEQ ID NO: 117;

(ii) a nucleic acid or fragment thereof that is complementary to SEQ ID NO: 11, SEQ ID NO: 13, SEQ ID NO: 31 or SEQ ID NO: 117;
(iii) a nucleic acid encoding a TFL1-like polypeptide having, in increasing order of preference, at least 90%, 91%, 92%, 93%, 94%, 95%, 96%, 97%, 98%, 99% or more sequence identity to SEQ ID NO: 11, SEQ ID NO: 13, SEQ ID NO: 31 or SEQ ID NO: 117;
(iv) a nucleic acid capable of hybridizing under stringent conditions to any one of the nucleic acids given in (i), (ii) or (iii) above.

According to a further embodiment of the present invention, there is therefore provided an isolated polypeptide comprising:
(i) an amino acid sequence having, in increasing order of preference, at least 97%, 98%, 99% or 100% sequence identity to SEQ ID NO: 12, SEQ ID NO: 14, SEQ ID NO: 32 or SEQ ID NO: 118;
(ii) derivatives of any of the amino acid sequences given in (i).

Nucleic acids encoding R5PI polypeptides may be derived from any natural or artificial source. The nucleic acid may be modified from its native form in composition and/or genomic environment through deliberate human manipulation. Preferably the R5PI polypeptide-encoding nucleic acid is from a plant, further preferably from a dicotyledonous plant, more preferably from the family Brassicaceae, most preferably the nucleic acid is from *Arabidopsis thaliana*.

Nucleic acid sequences encoding Znf A20/AN1 polypeptides may be derived from any natural or artificial source. The nucleic acid sequence may be modified from its native form in composition and/or genomic environment through deliberate human manipulation. Preferably the nucleic acid sequence encoding a Znf A20/AN1 polypeptide is from a plant, further preferably from a dicotyledonous plant, more preferably from the family Brassicaceae, most preferably the nucleic acid sequence is from *Arabidopsis thaliana*. Alternatively, the nucleic acid sequence encoding a Znf A20/AN1 polypeptide is more preferably from the family Fabaceae (also called Papillonaceae), most preferably the nucleic acid sequence is from *Medicago truncatula*.

Nucleic acid sequences encoding PHD-zf polypeptides may be derived from any natural or artificial source. The nucleic acid sequence may be modified from its native form in composition and/or genomic environment through deliberate human manipulation. The nucleic acid sequence encoding a PHD-zf polypeptide is from a plant, further preferably from a dicotyledonous plant, more preferably from the family Solanaceae, most preferably the nucleic acid sequence is from *Lycopersicon esculentum*.

Nucleic acids encoding REF/ALY polypeptides may be derived from any natural or artificial source. The nucleic acid may be modified from its native form in composition and/or genomic environment through deliberate human manipulation. Preferably the REF/ALY polypeptide-encoding nucleic acid is from a plant, further preferably from a dicotyledonous plant, more preferably from the family Brassicaceae, most preferably the nucleic acid is from *Arabidopsis thaliana*.

Advantageously, the invention also provides hitherto unknown REF/ALY-encoding nucleic acids and REF/ALY polypeptides.

According to a further embodiment of the present invention, there is therefore provided an isolated nucleic acid molecule selected from:

(i) a nucleic acid represented by any one of SEQ ID NO: 505, 507 and 535;
(ii) the complement of a nucleic acid represented by any one SEQ ID NO: 505, 507 and 535;
(iii) a nucleic acid encoding the polypeptide as represented by any one of SEQ ID NO: 506, 508 and 536, preferably as a result of the degeneracy of the genetic code, said isolated nucleic acid can be derived from a polypeptide sequence as represented by any one of SEQ ID NO: 506, 508 and 536 and further preferably confers enhanced yield-related traits relative to control plants;
(iv) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of table A and further preferably conferring enhanced yield-related traits relative to control plants;
(v) a nucleic acid molecule which hybridizes with a nucleic acid molecule of (i) to (iv) under stringent hybridization conditions and preferably confers enhanced yield-related traits relative to control plants;
(vi) a nucleic acid encoding an REF/ALY polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 506, 508 and 536 and any of the other polypeptide sequences in Table A5 and preferably conferring enhanced yield-related traits relative to control plants.

According to a further embodiment of the present invention, there is also provided an isolated polypeptide selected from:
(i) an amino acid sequence represented by any one of SEQ ID NO: 506, 508 and 536;
(ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 506, 508 and 536, and any of the other amino acid sequences in Table A5 and preferably conferring enhanced yield-related traits relative to control plants.
(iii) derivatives of any of the amino acid sequences given in (i) or (ii) above.

Performance of the methods of the invention gives plants having enhanced yield-related traits. In particular performance of the methods of the invention gives plants having increased yield, especially increased seed yield relative to control plants. The terms "yield" and "seed yield" are described in more detail in the "definitions" section herein.

Reference herein to enhanced yield-related traits is taken to mean an increase in biomass (weight) of one or more parts of a plant, which may include aboveground (harvestable) parts and/or (harvestable) parts below ground. In particular, such harvestable parts are seeds, and performance of the methods of the invention results in plants having increased seed yield relative to the seed yield of control plants.

Taking corn as an example, a yield increase may be manifested as one or more of the following: increase in the number of plants established per square meter, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per square meter, number of panicles per plant, number of spikelets per panicle, number of flowers (florets) per panicle (which is expressed as a ratio of the number of filled seeds over the number of primary panicles), increase in the seed filling rate (which is the number of filled seeds divided by the total number of seeds and multiplied by 100), increase in thousand kernel weight, among others.

The present invention provides a method for increasing yield, especially seed yield of plants, relative to control plants, which method comprises modulating expression in a plant of a nucleic acid encoding a TFL1-like polypeptide, or an R5PI polypeptide, or a Znf A20/AN1 polypeptide, or a PHD-zf polypeptide, or an REF/ALY polypeptide, as defined herein.

Since the transgenic plants according to the present invention have increased yield-related and/or seed yield-related traits, it is likely that these plants exhibit an increased growth rate (during at least part of their life cycle), relative to the growth rate of control plants at a corresponding stage in their life cycle.

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as speed of germination, early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per square meter (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

According to a preferred feature of the present invention, performance of the methods of the invention gives plants having an increased growth rate relative to control plants. Therefore, according to the present invention, there is provided a method for increasing the growth rate of plants, which method comprises modulating expression in a plant of a nucleic acid encoding a TFL1-like polypeptide, or a R5PI polypeptide, or a Znf A20/AN1 polypeptide, or a PHD-zf polypeptide, or a REF/ALY polypeptide, as defined herein.

An increase in yield and/or growth rate and/or yield-related traits and/or seed yield-related traits occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35% or 30%, preferably less than 25%, 20% or 15%, more preferably less than 14%, 13%, 12%, 11% or 10% or less in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, fungi, nematodes and insects.

In particular, the methods of the present invention may be performed under non-stress conditions or under conditions of mild drought to give plants having increased yield relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location. Plants with optimal growth conditions, (grown under non-stress conditions) typically yield in increasing order of preference at least 90%, 87%, 85%, 83%, 80%, 77% or 75% of the average production of such plant in a given environment. Average production may be calculated on harvest and/or season basis. Persons skilled in the art are aware of average yield productions of a crop.

Concerning TFL1-like polypeptides, performance of the methods of the invention gives plants grown under non-stress conditions or under mild drought conditions increased yield relative to control plants grown under comparable conditions. Therefore, according to the present invention, there is provided a method for increasing yield in plants grown under non-stress conditions or under mild drought conditions, which method comprises modulating expression in a plant of a nucleic acid encoding a TFL1-like polypeptide.

Concerning R5PI polypeptides, performance of the methods of the invention gives plants grown under non-stress conditions or under mild drought conditions increased yield relative to control plants grown under comparable conditions. Therefore, according to the present invention, there is provided a method for increasing yield in plants grown under non-stress conditions or under mild drought conditions, which method comprises modulating expression in a plant of a nucleic acid encoding a R5PI polypeptide.

Concerning Znf A20/AN1 polypeptides, performance of the methods of the invention gives plants grown under non-stress conditions or under mild stress conditions having increased yield-related traits, relative to control plants grown under comparable conditions. Therefore, according to the present invention, there is provided a method for increasing yield-related traits in plants grown under non-stress conditions or under mild stress conditions, which method comprises increasing expression in a plant of a nucleic acid sequence encoding a Znf A20/AN1 polypeptide.

Concerning PHD-zf polypeptides, performance of the methods of the invention gives plants grown under non-stress conditions or under mild stress conditions having increased seed yield-related traits, relative to control plants grown under comparable conditions. Therefore, according to the present invention, there is provided a method for increasing seed yield-related traits in plants grown under non-stress conditions or under mild stress conditions, which method comprises increasing expression in a plant of a nucleic acid sequence encoding a PHD-zf polypeptide.

Concerning REF/ALY polypeptides, performance of the methods of the invention gives plants grown under non-stress conditions or under mild drought conditions increased yield relative to control plants grown under comparable conditions. Therefore, according to the present invention, there is provided a method for increasing yield in plants grown under non-stress conditions or under mild drought conditions, which method comprises modulating expression in a plant of a nucleic acid encoding a REF/ALY polypeptide.

The term "abiotic stress" as defined herein is taken to mean any one or more of: water stress (due to drought or excess water), anaerobic stress, salt stress, temperature stress (due to hot, cold or freezing temperatures), chemical toxicity stress and oxidative stress. According to one aspect of the invention, the abiotic stress is an osmotic stress, selected from water stress, salt stress, oxidative stress and ionic stress. Preferably, the water stress is drought stress. The term salt stress is not restricted to common salt (NaCl), but may be any stress caused by one or more of: NaCl, KCl, LiCl, $MgCl_2$, $CaCl_2$, amongst others.

Concerning Znf A20/AN1 polypeptides, performance of the methods of the invention gives plants having increased yield-related traits, under abiotic stress conditions relative to control plants grown in comparable stress conditions. Therefore, according to the present invention, there is provided a method for increasing yield-related traits, in plants grown under abiotic stress conditions, which method comprises increasing expression in a plant of a nucleic acid sequence encoding a Znf A20/AN1 polypeptide. According to one aspect of the invention, the abiotic stress is an osmotic stress, selected from one or more of the following: water stress, salt stress, oxidative stress and ionic stress.

Concerning PHD-zf polypeptides, performance of the methods of the invention gives plants having increased seed yield-related traits, under abiotic stress conditions relative to control plants grown in comparable stress conditions. Therefore, according to the present invention, there is provided a method for increasing seed yield-related traits, in plants grown under abiotic stress conditions, which method comprises increasing expression in a plant of a nucleic acid sequence encoding a PHD-zf polypeptide. According to one aspect of the invention, the abiotic stress is an osmotic stress, selected from one or more of the following: water stress, salt stress, oxidative stress and ionic stress.

Another example of abiotic environmental stress is the reduced availability of one or more nutrients that need to be assimilated by the plants for growth and development. Because of the strong influence of nutrition utilization efficiency on plant yield and product quality, a huge amount of fertilizer is poured onto fields to optimize plant growth and quality. Productivity of plants ordinarily is limited by three primary nutrients, phosphorous, potassium and nitrogen, which is usually the rate-limiting element in plant growth of these three. Therefore the major nutritional element required for plant growth is nitrogen (N). It is a constituent of numerous important compounds found in living cells, including amino acids, proteins (enzymes), nucleic acids, and chlorophyll. 1.5% to 2% of plant dry matter is nitrogen and approximately 16% of total plant protein. Thus, nitrogen availability is a major limiting factor for crop plant growth and production (Frink et al. (1999) Proc Natl Acad Sci USA 96(4): 1175-1180), and has as well a major impact on protein accumulation and amino acid composition. Therefore, of great interest are crop plants with increased yield-related traits, when grown under nitrogen-limiting conditions.

Performance of the methods of the invention gives plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises modulating expression in a plant of a nucleic acid encoding a TFL1-like polypeptide, or a R5PI polypeptide, or a Znf A20/AN1 polypeptide, or a PHD-zf polypeptide, or a REF/ALY polypeptide. Nutrient deficiency may result from a lack of nutrients such as nitrogen, phosphates and other phosphorous-containing compounds, potassium, calcium, cadmium, magnesium, manganese, iron and boron, amongst others. Concerning Znf A20/AN1 polypeptides, or PHD-zf polypeptides, preferably, reduced nutrient availability is reduced nitrogen availability.

Performance of the methods of the invention gives plants grown under conditions of salt stress, increased yield relative to control plants grown under comparable conditions. Therefore, according to the present invention, there is provided a method for increasing yield in plants grown under conditions of salt stress, which method comprises modulating expression in a plant of a nucleic acid encoding a TFL1-like polypeptide, or a R5PI polypeptide, or a REF/ALY polypeptide. The term salt stress is not restricted to common salt (NaCl), but may be any one or more of: NaCl, KCl, LiCl, MgCl$_2$, CaCl$_2$, amongst others.

The present invention encompasses plants or parts thereof (including seeds) or cells thereof obtainable by the methods according to the present invention. The plants or parts thereof or cells thereof comprise a nucleic acid transgene encoding a TFL1-like polypeptide, or a R5PI polypeptide, or a Znf A20/AN1 polypeptide, or a PHD-zf polypeptide, or a REF/ALY polypeptide, as defined above.

The invention also provides genetic constructs and vectors to facilitate introduction and/or expression in plants of nucleic acids encoding TFL1-like polypeptides, or R5PI polypeptides, or Znf A20/AN1 polypeptides, or PHD-zf polypeptides, or REF/ALY polypeptide. The gene constructs may be inserted into vectors, which may be commercially available, suitable for transforming into plants and suitable for expression of the gene of interest in the transformed cells. The invention also provides use of a gene construct as defined herein in the methods of the invention.

More specifically, the present invention provides a construct comprising:
(a) a nucleic acid encoding a TFL1-like polypeptide, or a R5PI polypeptide, or a Znf A20/AN1 polypeptide, or a PHD-zf polypeptide, or a REF/ALY polypeptide, as defined above;
(b) one or more control sequences capable of driving expression of the nucleic acid sequence of (a); and optionally
(c) a transcription termination sequence.

Preferably, the nucleic acid encoding a REF/ALY polypeptide is as defined above. The term "control sequence" and "termination sequence" are as defined herein.

Concerning PHD-zf polypeptides, preferably, one of the control sequences of a construct is a constitutive promoter isolated from a plant genome. An example of a constitutive promoter is a GOS2 promoter, preferably a GOS2 promoter from rice, most preferably a GOS2 sequence as represented by SEQ ID NO: 494.

Plants are transformed with a vector comprising any of the nucleic acids described above. The skilled artisan is well aware of the genetic elements that must be present on the vector in order to successfully transform, select and propagate host cells containing the sequence of interest. The sequence of interest is operably linked to one or more control sequences (at least to a promoter).

Concerning TFL1-like polypeptides, advantageously, any type of promoter, whether natural or synthetic, may be used to drive expression of the nucleic acid sequence, but preferably the promoter is of plant origin. A constitutive promoter is particularly useful in the methods. Preferably the constitutive promoter is also a ubiquitous promoter of medium strength. See the "Definitions" section herein for definitions of the various promoter types.

Concerning R5PI polypeptides, advantageously, any type of promoter, whether natural or synthetic, may be used to drive expression of the nucleic acid sequence, but preferably the promoter is of plant origin. A constitutive promoter is particularly useful in the methods. Preferably the constitutive promoter is also a ubiquitous promoter of medium strength. See the "Definitions" section herein for definitions of the various promoter types Concerning Znf A20/AN1 polypeptides, advantageously, any type of promoter, whether natural or synthetic, may be used to increase expression of the nucleic acid sequence. A constitutive promoter is particularly useful in the methods, preferably a constitutive promoter isolated from a plant genome. The plant constitutive promoter drives expression of a coding sequence at a level that is in all instances below that obtained under the control of a 35S CaMV viral promoter.

Other organ-specific promoters, for example for preferred expression in leaves, stems, tubers, meristems, seeds (embryo and/or endosperm), are useful in performing the methods of the invention. See the "Definitions" section herein for definitions of the various promoter types.

Concerning PHD-zf polypeptides, advantageously, any type of promoter, whether natural or synthetic, may be used to increase expression of the nucleic acid sequence. A constitutive promoter is particularly useful in the methods, preferably a constitutive promoter isolated from a plant genome. The plant constitutive promoter drives expression of a coding sequence at a level that is in all instances below that obtained under the control of a 35S CaMV viral promoter. An example of such a promoter is a GOS2 promoter as represented by SEQ ID NO: 494.

Organ-specific promoters, for example for preferred expression in leaves, stems, tubers, meristems, seeds, are useful in performing the methods of the invention. Developmentally-regulated and inducible promoters are also useful in performing the methods of the invention. See the "Definitions" section herein for definitions of the various promoter types.

Concerning REF/ALY polypeptides, advantageously, any type of promoter, whether natural or synthetic, may be used to drive expression of the nucleic acid sequence, but preferably the promoter is of plant origin. A constitutive promoter is particularly useful in the methods. Preferably the constitutive promoter is also a ubiquitous promoter of medium strength. See the "Definitions" section herein for definitions of the various promoter types.

Concerning TFL1-like polypeptides, it should be clear that the applicability of the present invention is not restricted to the TFL1-like polypeptide-encoding nucleic acid represented by SEQ ID NO: 1, nor is the applicability of the invention restricted to expression of a TFL1-like polypeptide-encoding nucleic acid when driven by a constitutive promoter.

The constitutive promoter is preferably a promoter from plant origin, preferably a medium strength promoter such as a GOS2 promoter, more preferably the promoter is a GOS2 promoter from rice. Even further preferably the constitutive promoter is represented by a nucleic acid sequence substantially similar to SEQ ID NO: 128, most preferably the constitutive promoter is as represented by SEQ ID NO: 128. See the "Definitions" section herein for further examples of constitutive promoters.

Concerning R5PI polypeptides, it should be clear that the applicability of the present invention is not restricted to the R5PI polypeptide-encoding nucleic acid represented by SEQ ID NO: 140, nor is the applicability of the invention restricted to expression of a R5PI polypeptide-encoding nucleic acid when driven by a constitutive promoter.

The constitutive promoter is preferably a medium strength promoter, more preferably selected from a plant derived promoter, such as a GOS2 promoter, more preferably is the promoter GOS2 promoter from rice. Further preferably the constitutive promoter is represented by a nucleic acid sequence substantially similar to SEQ ID NO: 211, most preferably the constitutive promoter is as represented by SEQ ID NO: 211. See the "Definitions" section herein for further examples of constitutive promoters.

Optionally, one or more terminator sequences may be used in the construct introduced into a plant. Preferably, the construct comprises an expression cassette comprising a GOS2 promoter, substantially similar to SEQ ID NO: 211, and the nucleic acid encoding the R5PI polypeptide.

Concerning Znf A20/AN1 polypeptides, it should be clear that the applicability of the present invention is not restricted to a nucleic acid sequence encoding the Znf A20/AN1 polypeptide, as represented by SEQ ID NO: 212 or by SEQ ID NO: 214, nor is the applicability of the invention restricted to expression of a Znf A20/AN1 polypeptide-encoding nucleic acid sequence when driven by a constitutive promoter.

Optionally, one or more terminator sequences may be used in the construct introduced into a plant. Additional regulatory elements may include transcriptional as well as translational increasers. Those skilled in the art will be aware of terminator and increaser sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, increaser, silencer, intron sequences, 3'UTR and/or 5'UTR regions) may be protein and/or RNA stabilizing elements. Such sequences would be known or may readily be obtained by a person skilled in the art.

Concerning PHD-zf polypeptides, it should be clear that the applicability of the present invention is not restricted to a nucleic acid sequence encoding the PHD-zf polypeptide, as represented by SEQ ID NO: 347, nor is the applicability of the invention restricted to expression of a PHD-zf polypeptide-encoding nucleic acid sequence when driven by a constitutive promoter.

Optionally, one or more terminator sequences may be used in the construct introduced into a plant. Additional regulatory elements may include transcriptional as well as translational increasers. Those skilled in the art will be aware of terminator and increaser sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, increaser, silencer, intron sequences, 3'UTR and/or 5'UTR regions) may be protein and/or RNA stabilizing elements. Such sequences would be known or may readily be obtained by a person skilled in the art.

Concerning REF/ALY polypeptides, it should be clear that the applicability of the present invention is not restricted to the REF/ALY polypeptide-encoding nucleic acid represented by SEQ ID NO: 497, nor is the applicability of the invention restricted to expression of a REF/ALY polypeptide-encoding nucleic acid when driven by a constitutive promoter.

The constitutive promoter is preferably a medium strength promoter, more preferably selected from a plant derived promoter, such as a GOS2 promoter or a HMGP (High Mobility Group Protein) promoter, more preferably is the GOS2 promoter from rice or a HMGP promoter from rice. Further preferably the constitutive promoter is represented by a nucleic acid sequence substantially similar to SEQ ID NO: 547 or to SEQ ID NO: 548, most preferably the constitutive promoter is as represented by SEQ ID NO: 547 or to SEQ ID NO: 548. See the "Definitions" section herein for further examples of constitutive promoters.

Optionally, one or more terminator sequences may be used in the construct introduced into a plant. Preferably, the construct comprises an expression cassette comprising a GOS2 promoter, substantially similar to SEQ ID NO: 547 or to SEQ ID NO: 548, and the nucleic acid encoding the REF/ALY polypeptide.

Additional regulatory elements may include transcriptional as well as translational enhancers. Those skilled in the art will be aware of terminator and enhancer sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein. The marker genes may be removed or excised from the transgenic cell once they are no longer needed. Techniques for marker removal are known in the art, useful techniques are described above in the definitions section.

It is known that upon stable or transient integration of nucleic acid sequences into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid sequence molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid sequence can be identified for example by selection (for example, cells which have integrated the selectable marker survive whereas the other cells die). The marker genes may be removed or excised from the transgenic cell once they are no longer needed. Techniques for marker gene removal are known in the art, useful techniques are described above in the definitions section.

Concerning TFL1-like polypeptides, the invention also provides a method for the production of transgenic plants having enhanced yield-related traits relative to control plants, comprising introduction and expression in a plant of any nucleic acid encoding a TFL1-like polypeptide as defined hereinabove.

More specifically, the present invention provides a method for the production of transgenic plants having enhanced yield-related traits, particularly increased (seed) yield, which method comprises:

(i) introducing and expressing in a plant or plant cell a TFL1-like polypeptide-encoding nucleic acid; and
(ii) cultivating the plant cell under conditions promoting plant growth and development.

The nucleic acid of (i) may be any of the nucleic acids capable of encoding a TFL1-like polypeptide as defined herein.

Concerning R5PI polypeptides, the invention also provides a method for the production of transgenic plants having enhanced yield-related traits relative to control plants, comprising introduction and expression in a plant of any nucleic acid encoding a R5PI polypeptide as defined hereinabove.

More specifically, the present invention provides a method for the production of transgenic plants having enhanced yield-related traits, particularly increased (seed) yield, which method comprises:

(i) introducing and expressing in a plant or plant cell a R5PI polypeptide-encoding nucleic acid; and
(ii) cultivating the plant cell under conditions promoting plant growth and development.

The nucleic acid of (i) may be any of the nucleic acids capable of encoding a R5PI polypeptide as defined herein.

Concerning Znf A20/AN1 polypeptides, the invention also provides a method for the production of transgenic plants having increased yield-related traits relative to control plants, comprising introduction and expression in a plant of any nucleic acid sequence encoding a Znf A20/AN1 polypeptide as defined hereinabove.

More specifically, the present invention provides a method for the production of transgenic plants having increased yield-related traits relative to control plants, which method comprises:

(i) introducing and expressing in a plant, plant part, or plant cell a nucleic acid sequence encoding a Znf A20/AN1 polypeptide; and
(ii) cultivating the plant cell, plant part or plant under conditions promoting plant growth and development.

The nucleic acid sequence of (i) may be any of the nucleic acid sequences capable of encoding a Znf A20/AN1 polypeptide as defined herein.

Concerning PHD-zf polypeptides, the invention also provides a method for the production of transgenic plants having increased seed yield-related traits relative to control plants, comprising introduction and expression in a plant of any nucleic acid sequence encoding a PHD-zf polypeptide as defined hereinabove.

More specifically, the present invention provides a method for the production of transgenic plants having increased seed yield-related traits relative to control plants, which method comprises:

(i) introducing and expressing in a plant, plant part, or plant cell a nucleic acid sequence encoding a PHD-zf polypeptide; and
(ii) cultivating the plant cell, plant part or plant under conditions promoting plant growth and development.

The nucleic acid sequence of (i) may be any of the nucleic acid sequences capable of encoding a PHD-zf polypeptide as defined herein.

Concerning REF/ALY polypeptides, the invention also provides a method for the production of transgenic plants having enhanced yield-related traits relative to control plants, comprising introduction and expression in a plant of any nucleic acid encoding a REF/ALY polypeptide as defined hereinabove.

More specifically, the present invention provides a method for the production of transgenic plants having enhanced yield-related traits, particularly increased (seed) yield, which method comprises:

(i) introducing and expressing in a plant or plant cell a REF/ALY polypeptide-encoding nucleic acid; and
(ii) cultivating the plant cell under conditions promoting plant growth and development.

The nucleic acid of (i) may be any of the nucleic acids capable of encoding a REF/ALY polypeptide as defined herein.

The nucleic acid may be introduced directly into a plant cell or into the plant itself (including introduction into a tissue, organ or any other part of a plant). According to a preferred feature of the present invention, the nucleic acid is preferably introduced into a plant by transformation. The term "transformation" is described in more detail in the "definitions" section herein.

The genetically modified plant cells can be regenerated via all methods with which the skilled worker is familiar. Suitable methods can be found in the abovementioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid encoding a TFL1-like polypeptide, or a R5PI polypeptide, or a Znf A20/AN1 polypeptide, or a PHD-zf polypeptide, or a REF/ALY polypeptide, as defined hereinabove. Preferred host cells according to the invention are plant cells. Host plants for the nucleic acids or the vector used in the method according to the invention, the expression cassette or construct or vector are, in principle, advantageously all plants, which are capable of synthesizing the polypeptides used in the inventive method.

The methods of the invention are advantageously applicable to any plant. Plants that are particularly useful in the methods of the invention include all plants which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant. Examples of crop plants include soybean, sunflower, canola, alfalfa, rapeseed, linseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, triticale, sorghum, emmer, spelt, secale, einkorn, teff, milo and oats.

The invention also extends to harvestable parts of a plant such as, but not limited to seeds, leaves, fruits, flowers, stems, roots, rhizomes, tubers and bulbs, which harvestable parts comprise a recombinant nucleic acid encoding a TFL1-like polypeptide, or a R5PI polypeptide, or a Znf A20/AN1 polypeptide, or a PHD-zf polypeptide, or a REF/ALY polypeptide. The invention furthermore relates to products derived, preferably directly derived, from a harvestable part of such a plant, such as dry pellets or powders, oil, fat and fatty acids, starch or proteins.

According to a preferred feature of the invention, the modulated expression is increased expression. Methods for increasing expression of nucleic acids or genes, or gene products, are well documented in the art and examples are provided in the definitions section.

As mentioned above, a preferred method for modulating expression of a nucleic acid encoding a TFL1-like polypeptide, or a R5PI polypeptide, or a Znf A20/AN1 polypeptide, or a PHD-zf polypeptide, or a REF/ALY polypeptide, is by introducing and expressing in a plant a nucleic acid encoding a TFL1-like polypeptide, or a R5PI polypeptide, or a Znf A20/AN1 polypeptide, or a PHD-zf polypeptide, or a REF/ALY polypeptide; however the effects of performing the method, i.e. enhancing yield-related traits may also be achieved using other well known techniques, including but not limited to T-DNA activation tagging, TILLING, homologous recombination. A description of these techniques is provided in the definitions section.

The present invention also encompasses use of nucleic acids encoding TFL1-like polypeptides as described herein and use of these TFL1-like polypeptides in enhancing any of the aforementioned yield-related traits in plants.

Furthermore, the present invention also encompasses use of nucleic acids encoding R5PI polypeptides as described herein and use of these R5PI polypeptides in enhancing any of the aforementioned yield-related traits in plants.

Even furthermore, the present invention also encompasses use of nucleic acid sequences encoding Znf A20/AN1 polypeptides as described herein and use of these Znf A20/AN1 polypeptides in increasing any of the aforementioned yield-related traits in plants, under normal growth conditions, under abiotic stress growth (preferably osmotic stress growth conditions) conditions, and under growth conditions of reduced nutrient availability, preferably under conditions of reduced nitrogen availability.

Yet furthermore, the present invention also encompasses use of nucleic acid sequences encoding PHD-zf polypeptides as described herein and use of these PHD-zf polypeptides in increasing any of the aforementioned seed yield-related traits in plants, under normal growth conditions, under abiotic stress growth (preferably osmotic stress growth conditions) conditions, and under growth conditions of reduced nutrient availability, preferably under conditions of reduced nitrogen availability.

Furthermore, the present invention also encompasses use of nucleic acids encoding REF/ALY polypeptides as described herein and use of these REF/ALY polypeptides in enhancing any of the aforementioned yield-related traits in plants.

Nucleic acids encoding TFL1-like polypeptides, or R5PI polypeptides, or Znf A20/AN1 polypeptides, or PHD-zf polypeptides, or REF/ALY polypeptides, described herein, or the TFL1-like polypeptides, or R5PI polypeptides, or Znf A20/AN1 polypeptides, or PHD-zf polypeptides, or REF/ALY polypeptides themselves, may find use in breeding programmes in which a DNA marker is identified which may be genetically linked to a gene encoding TFL1-like polypeptides, or R5PI polypeptides, or Znf A20/AN1 polypeptides, or PHD-zf polypeptides, or REF/ALY polypeptides. The nucleic acids/genes, or the TFL1-like polypeptides, or R5PI polypeptides, or Znf A20/AN1 polypeptides, or PHD-zf polypeptides, or REF/ALY polypeptides themselves may be used to define a molecular marker. This DNA or protein marker may then be used in breeding programmes to select plants having enhanced yield-related traits and/or seed yield-related traits as defined hereinabove in the methods of the invention.

Allelic variants of a nucleic acid/gene encoding TFL1-like polypeptides, or R5PI polypeptides, or Znf A20/AN1 polypeptides, or PHD-zf polypeptides, or REF/ALY polypeptides, may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Nucleic acids encoding TFL1-like polypeptides, or R5PI polypeptides, or Znf A20/AN1 polypeptides, or PHD-zf polypeptides, or REF/ALY polypeptides, may also be used as probes for genetically and physically mapping the genes that they are a part of, and as markers for traits linked to those genes. Such information may be useful in plant breeding in order to develop lines with desired phenotypes. Such use of nucleic acids encoding TFL1-like polypeptides, or R5PI polypeptides, or Znf A20/AN1 polypeptides, or PHD-zf polypeptides, or REF/ALY polypeptides, requires only a nucleic acid sequence of at least 15 nucleotides in length. The TFL1-like polypeptide-encoding nucleic acids may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the nucleic acids encoding TFL1-like polypeptides, or R5PI polypeptides, or Znf A20/AN1 polypeptides, or PHD-zf polypeptides, or REF/ALY polypeptides. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the nucleic acid encoding TFL1-like polypeptides, or R5PI polypeptides, or Znf A20/AN1 polypeptides, or PHD-zf polypeptides, or REF/ALY polypeptides, in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in plants having increased yield-related traits, as described hereinbefore. These traits may also be combined with other economically advantageous traits, such as further yield-increasing traits, tolerance to abiotic and biotic stresses, tolerance to herbicides, insecticides, traits modifying various architectural features and/or biochemical and/or physiological features.

Items

1. A method for enhancing yield-related traits in plants relative to control plants, comprising modulating expression in a plant of a nucleic acid encoding a TFL1-like, Terminal Flower1-like, polypeptide and optionally selecting for plants having enhanced seed yield.
2. Method according to item 1, wherein said TFL1-like polypeptide comprises a sequence having in increasing order of preference:
   (i) a phosphatidylethanolamine-binding protein (PEBP) domain (domain accession number in pfam: PFAM01161), preferably as present in any one the polypeptides of Table A, more preferably as represented by the sequence comprised between amino acids 66-88 in SEQ ID NO: 2, even more preferably as present in SEQ ID NO: 26 (P.trichocarpa__575797_BFT); and
   (ii) a conserved Histidine (His or H) or preferably a Tyrosine (Tyr or Y) residue at a location equivalent to that of amino acid residues His86 (H86) in SEQ ID NO: 2 and a conserved Aspartic amino acid (D) or preferably a Glutamic amino acid (Glu) residue at a location equivalent to that of amino acid residues Asp142 (D142) in SEQ ID NO: 2.
3. Method according to item 1 or 2, wherein said modulated expression is effected by introducing and expressing in a plant a nucleic acid encoding a TFL1-like polypeptide.
4. Method according to any preceding item, wherein said nucleic acid encoding a TFL1-like polypeptide encodes any one of the proteins listed in Table A1 or is a portion of such a nucleic acid, or a nucleic acid capable of hybridising with such a nucleic acid.
5. Method according to any preceding item, wherein said nucleic acid sequence encodes an orthologue or paralogue of any of the proteins given in Table A1.
6. Method according to any preceding item, wherein said enhanced yield-related traits comprise increased biomass, preferably shoot and/or root biomass relative to control plants.
7. A method according to item 1 wherein said enhanced yield-related trait is selected from the group consisting of seed yield, number of seeds per plant, number of filled seeds per panicle and harvest index.
8. Method according to any one of items 1 to 7, wherein said enhanced yield-related traits are obtained under non-stress conditions or under drought stress growth conditions.
9. Method according to any one of items 3 to 8, wherein said nucleic acid is operably linked to a constitutive promoter, preferably to a GOS2 promoter, most preferably to a GOS2 promoter from rice.
10. Method according to any preceding item, wherein said nucleic acid encoding a TFL1-like polypeptide is of plant origin, preferably from a dicotyledonous plant, further preferably from the family Salicaceae, most preferably from *Populus tichocarpa*.
11. Plant or part thereof, including seeds, obtainable by a method according to any preceding item, wherein said plant or part thereof comprises a recombinant nucleic acid encoding a TFL1-like polypeptide.
12. An isolated nucleic acid molecule comprising any one of the following:

(i) a nucleic acid represented by SEQ ID NO: 11, SEQ ID NO: 13, SEQ ID NO: 31 or SEQ ID NO: 117;
(ii) a nucleic acid or fragment thereof that is complementary to (i) SEQ ID NO: 11, SEQ ID NO: 13, SEQ ID NO: 31 or SEQ ID NO: 117;
(iii) a nucleic acid encoding a TFL1-like polypeptide having, in increasing order of preference, at least 90%, 91%, 92%, 93%, 94%, 95%, 96%, 97%, 98%, 99% or more sequence identity to (i) SEQ ID NO: 11, SEQ ID NO: 13, SEQ ID NO: 31 or SEQ ID NO: 117;
(iv) a nucleic acid capable of hybridizing under stringent conditions to any one of the nucleic acids given in (i), (ii) or (iii) above.

13. An isolated polypeptide comprising:
(i) an amino acid sequence having, in increasing order of preference, at least 97%, 98%, 99% or 100% sequence identity to (i) SEQ ID NO: 12, SEQ ID NO: 14, SEQ ID NO: 32 or SEQ ID NO: 118; and/or
(ii) derivatives of any of the amino acid sequences given in (i).

13. Construct comprising:
(i) nucleic acid encoding a TFL1-like polypeptide as defined in items 1, 2 or 13, or a nucleic acid according to item 12;
(ii) one or more control sequences capable of driving expression of the nucleic acid sequence of (a); and optionally
(iii) a transcription termination sequence.

14. Construct according to item 14, wherein one of said control sequences is a constitutive promoter, preferably a GOS2 promoter, most preferably a GOS2 promoter from rice.

16. Use of a construct according to item 14 or 15 in a method for making plants having increased seed yield relative to control plants.

17. Plant, plant part or plant cell transformed with a construct according to item 14 or 15.

18. Method for the production of a transgenic plant having increased yield, preferably increased seed yield relative to control plants, comprising:
(i) introducing and expressing in a plant a nucleic acid encoding a TFL1-like polypeptide as defined in item 1, 2 or 13, or a nucleic acid according to item 12; and
(ii) cultivating the plant cell under conditions promoting plant growth and development; and optionally
(iii) selecting for plants having increased seed yield 19. Transgenic plant having increased yield, particularly increased biomass, relative to control plants, resulting from modulated expression of a nucleic acid encoding a TFL1-like polypeptide as defined in item 1, 2 or 13 or a transgenic plant cell derived from said transgenic plant.

20. Transgenic plant according to item 11, 17 or 19, or a transgenic plant cell derived thereof, wherein said plant is a crop plant or a monocot or a cereal, such as rice, maize, wheat, barley, millet, rye, triticale, sorghum and oats.

21. Harvestable parts of a plant according to item 20, wherein said harvestable parts are preferably shoot biomass and/or seeds.

22. Products derived from a plant according to item 20 and/or from harvestable parts of a plant according to item 21.

23. Use of a nucleic acid encoding a TFL1-like polypeptide in increasing seed yield relative to control plants.

24. A method for enhancing yield-related traits in plants relative to control plants, comprising modulating expression in a plant of a nucleic acid encoding an R5PI, Ribose 5 Phosphate Isomerase, polypeptide and optionally selecting for plants having enhanced seed yield.

25. Method according to item 24, wherein said R5PI polypeptide comprises a sequence having in increasing order of preference:
(i) a protein domain having 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the Rib_5-Pisom_A domain in SEQ ID NO: 140 as represented by SEQ ID NO: 204 and/or
(ii) 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to the amino acid sequence of any of the polypeptides of Table A2; and/or
(iii) a motif having in increasing order of preference 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to the amino acid represented by any one of Motif 6 to Motif 9 as represented by SEQ ID NO: 205 to 208 respectively.

26. Method according to item 24 or 25, wherein said modulated expression is effected by introducing and expressing in a plant a nucleic acid encoding an R5PI polypeptide.

27. Method according to any one of items 24 to 26, wherein said nucleic acid encoding an R5PI polypeptide encodes any one of the proteins listed in Table A2 or is a portion of such a nucleic acid, or a nucleic acid capable of hybridising with such a nucleic acid.

28. Method according to any one of items 24 to 27, wherein said nucleic acid sequence encodes an orthologue or paralogue of any of the proteins given in Table A2.

29. Method according to any one of items 24 to 28, wherein said enhanced yield-related traits comprise increased biomass, preferably shoot and/or root biomass relative to control plants.

30. A method according to Item 24 to 28 wherein said enhanced yield-related trait is selected from the group consisting of the total seed weight per plant, the number of seeds per plant, the number of filled seeds per plant and the number of flowers per panicle.

31. Method according to any one of items 24 to 30, wherein said enhanced yield-related traits are obtained under non-stress conditions.

32. Method according to any one of items 24 to 30, wherein said enhanced yield-related traits are obtained under nitrogen deficiency growth conditions.

33. Method according to any one of items 26 to 32, wherein said nucleic acid is operably linked to a constitutive promoter, preferably to a GOS2 promoter, most preferably to a GOS2 promoter from rice.

34. Method according to any one of items 24 to 33, wherein said nucleic acid encoding an R5PI polypeptide is of plant origin, preferably from a dicotyledonous plant, further preferably from the family Brassicaceae, most preferably from *Arabidopsis thaliana*.

35. Plant or part thereof, including seeds, obtainable by a method according to any preceding item, wherein said plant or part thereof comprises a recombinant nucleic acid encoding a TFL1-like polypeptide.

36. Construct comprising:
   (i) nucleic acid encoding an R5PI polypeptide as defined in items 24 or 25;
   (ii) one or more control sequences capable of driving expression of the nucleic acid sequence of (a); and optionally
   (iii) a transcription termination sequence.
37. Construct according to item 36, wherein one of said control sequences is a constitutive promoter, preferably a GOS2 promoter, most preferably a GOS2 promoter from rice.
38. Use of a construct according to item 36 or 37 in a method for making plants having increased seed yield relative to control plants.
39. Plant, plant part or plant cell transformed with a construct according to item 35 or 38.
40. Method for the production of a transgenic plant having increased yield, preferably increased seed yield relative to control plants, comprising:
   (i) introducing and expressing in a plant a nucleic acid encoding an R5PI polypeptide as defined in item 24 or 25; and
   (ii) cultivating the plant cell under conditions promoting plant growth and development; and optionally
   (iii) selecting for plants having increased seed yield
41. Transgenic plant having increased yield, particularly increased biomass, relative to control plants, resulting from modulated expression of a nucleic acid encoding an R5PI polypeptide as defined in item 24 or 25 or a transgenic plant cell derived from said transgenic plant.
42. Transgenic plant according to item 35, 39 or 40, or a transgenic plant cell derived thereof, wherein said plant is a crop plant or a monocot or a cereal, such as rice, maize, wheat, barley, millet, rye, triticale, sorghum and oats.
43. Harvestable parts of a plant according to item 42, wherein said harvestable parts are preferably shoot biomass and/or seeds.
44. Products derived from a plant according to item 42 and/or from harvestable parts of a plant according to item 43.
45. Use of a nucleic acid encoding an R5PI polypeptide in increasing seed yield relative to control plants.
46. A method for increasing yield-related traits in plants relative to control plants, comprising increasing expression in a plant of a nucleic acid sequence encoding a zinc finger (Znf) domain-containing A20/AN1 polypeptide, which Znf A20/AN1 polypeptide comprises (i) at least one A20-type zinc finger domain with an InterPro accession IPR002653 (ProSite accession PS51036); and (ii) at least one AN1-type zinc finger domain with an InterPro accession IPR000058 (ProSite accession PS51039), and optionally selecting for plants having increased yield-related traits.
47. Method according to item 46, wherein said Znf A20/AN1 polypeptide comprises: (i) a domain having at least 40%, 45%, 50%, 55%, 60%, 65%, 70%, 75%, 80%, 85%, 90%, 95%, 98%, 99% or more amino acid sequence identity to an A20-type zinc finger domain as represented by SEQ ID NO: 338, or by SEQ ID NO: 339; and (ii) a domain having at least 40%, 45%, 50%, 55%, 60%, 65%, 70%, 75%, 80%, 85%, 90%, 95%, 98%, 99% or more amino acid sequence identity to an AN1-type zinc finger domain as represented by SEQ ID NO: 340, or by SEQ ID NO: 341.
48. Method according to item 46 or 47, wherein said Znf A20/AN1 polypeptide has in increasing order of preference at least 40%, 45%, 50%, 55%, 60%, 65%, 70%, 75%, 80%, 85%, 90%, 95%, 98%, 99% or more amino acid sequence identity to a Znf A20/AN1 polypeptide as represented by SEQ ID NO: 213, or by SEQ ID NO: 215, or to any of the polypeptide sequences given in Table A3 herein.
49. Method according to any one of items 46 to 48, wherein said nucleic acid sequence encoding a Znf A20/AN1 polypeptide is represented by any one of the nucleic acid sequence SEQ ID NOs given in Table A3 or a portion thereof, or a sequence capable of hybridising with any one of the nucleic acid sequences SEQ ID NOs given in Table A4.
50. Method according to any one of items 46 to 49, wherein said nucleic acid sequence encodes an orthologue or paralogue of any of the polypeptide sequence SEQ ID NOs given in Table A3.
51. Method according to any one of items 46 to 50, wherein said increased expression is effected by any one or more of: T-DNA activation tagging, TILLING, or homologous recombination.
52. Method according to any one of items 46 to 51, wherein said increased expression is effected by introducing and expressing in a plant a nucleic acid sequence encoding a Znf A20/AN1 polypeptide.
53. Method according to any any one of items 46 to 52, wherein said increased yield-related trait is one or more of: (i) increased early vigour; (ii) increased aboveground biomass; (iii) increased total seed yield per plant; (iv) increased number of filled seeds; (v) increased seed filling rate; or (v) increased harvest index.
54. Method according to any one of items 46 to 48, wherein said nucleic acid sequence is operably linked to a constitutive promoter, preferably to a plant constitutive promoter, more preferably to a GOS2 promoter, most preferably to a GOS2 promoter from rice as represented by SEQ ID NO: 342.
55. Method according to any one of items 46 to 54, wherein said nucleic acid sequence encoding a Znf A20/AN1 polypeptide is of plant origin, preferably from a dicotyledonous plant, further preferably from the family Brassicaceae, most preferably from *Arabidopsis thaliana*.
56. Method according to any one of item 46 to 54, wherein said nucleic acid sequence encoding a Znf A20/AN1 polypeptide is of plant origin, preferably from a dicotyledonous plant, further preferably from the family Fabaceae, most preferably from *Medicago truncatula*.
57. Plants, parts thereof (including seeds), or plant cells obtainable by a method according to any preceding item, wherein said plant, part or cell thereof comprises an isolated nucleic acid transgene encoding a Znf A20/AN1.
58. An isolated nucleic acid sequence comprising:
   (i) a nucleic acid sequence as represented by any one of SEQ ID NOs: 280, 282, 284, 286, 288, 290, 292, 294, 296, 298, 300, 302, 304, 306, 308, 310, 312, 314, 316, 318, 320, 322, 324, 326, 328, 330, 332, 334, or 336;
   (ii) the complement of a nucleic acid sequence as represented by any one of SEQ ID NOs: 280, 282, 284, 286, 288, 290, 292, 294, 296, 298, 300, 302, 304, 306, 308, 310, 312, 314, 316, 318, 320, 322, 324, 326, 328, 330, 332, 334, or 336;
   (iii) a nucleic acid sequence encoding a polypeptide having, in increasing order of preference, at least 70%, 75%, 80%, 85%, 90%, 95%, 96%, 97%, 98%, 99% or more amino acid sequence identity to a polypeptide sequence as represented by any one of SEQ ID NOs: 281, 283, 285, 287, 289, 291, 293, 295, 297, 299, 301, 303, 305, 307, 309, 311, 313, 315, 317, 319, 321, 323, 325, 327, 329, 331, 333, 335, or 337;

59. An isolated polypeptide comprising:
   (i) a polypeptide sequence represented by any one of SEQ ID NOs: 281, 283, 285, 287, 289, 291, 293, 295, 297, 299, 301, 303, 305, 307, 309, 311, 313, 315, 317, 319, 321, 323, 325, 327, 329, 331, 333, 335, or 337;
   (ii) a polypeptide sequence having, in increasing order of preference, at least 70%, 75%, 80%, 85%, 90%, 95%, 96%, 97%, 98%, 99% or more amino acid sequence identity to a polypeptide sequence as represented by any one of SEQ ID NOs: 281, 283, 285, 287, 289, 291, 293, 295, 297, 299, 301, 303, 305, 307, 309, 311, 313, 315, 317, 319, 321, 323, 325, 327, 329, 331, 333, 335, or 337;
   (iii) derivatives of any of the polypeptide sequences given in (i) or (ii) above.

60. Construct comprising:
   (a) A nucleic acid sequence encoding a Znf A20/AN1 polypeptide as defined in any one of items 46 to 50, or 58;
   (b) one or more control sequences capable of driving expression of the nucleic acid sequence of (a); and optionally
   (c) a transcription termination sequence.

61. Construct according to item 15, wherein said control sequence is a constitutive promoter, preferably a GOS2 promoter, more preferably a GOS2 promoter as represented by SEQ ID NO: 342.

62. Use of a construct according to items 60 or 61 in a method for making plants having increased yield-related traits relative to control plants, which increased yield-related traits are any one or more of: (i) increased early vigour; (ii) increased aboveground biomass; (iii) increased total seed yield per plant; (iv) increased number of filled seeds; (v) increased seed filling rate; or (vi) increased harvest index.

63. Plant, plant part or plant cell transformed with a construct according to item 60 or 61.

64. Method for the production of transgenic plants having increased yield-related traits relative to control plants, comprising:
   (i) introducing and expressing in a plant, plant part, or plant cell, a nucleic acid sequence encoding a Znf A20/AN1 polypeptide as defined in any one of items 46 to 50, or 58; and
   (ii) cultivating the plant cell, plant part, or plant under conditions promoting plant growth and development.

65. Transgenic plant having increased yield-related traits relative to control plants, resulting from increased expression of a nucleic acid sequence encoding a Znf A20/AN1 polypeptide as defined in any one of items 46 to 50, or 58, or a transgenic plant cell or transgenic plant part derived from said transgenic plant.

66. Transgenic plant according to item 57, 63 or 65, wherein said plant is a crop plant or a monocot or a cereal, such as rice, maize, wheat, barley, millet, rye, triticale, sorghum and oats, or a transgenic plant cell derived from said transgenic plant.

67. Harvestable parts comprising an isolated nucleic acid sequence encoding a Znf A20/AN1 polypeptide of a plant according to item 66, wherein said harvestable parts are preferably seeds.

68. Products derived from a plant according to item 66 and/or from harvestable parts of a plant according to item 67.

69. Use of a nucleic acid sequence encoding a Znf A20/AN1 polypeptide as defined in any one of items 46 to 50, or 58, in increasing yield-related traits, comprising one or more of: (i) increased early vigour; (ii) increased aboveground biomass; (iii) increased total seed yield per plant; (iv) increased number of filled seeds; (v) increased seed filling rate; or (vi) increased harvest index.

70. A method for increasing seed yield-related traits in plants relative to control plants, comprising increasing expression in a plant of a nucleic acid sequence encoding a plant homeodomain zinc finger (PHD-zf) polypeptide, which PHD-zf polypeptide comprises in increasing order of preference at least 50%, 55%, 60%, 65%, 70%, 75%, 80%, 85%, 90%, 95%, 98%, 99% or more amino acid sequence identity to a Conserved Domain as represented by SEQ ID NO: 145; and (ii) in increasing order of preference at least 50%, 55%, 60%, 65%, 70%, 75%, 80%, 85%, 90%, 95%, 98%, 99% or more amino acid sequence identity to a plant homeodomain zinc finger (PHD-zf) domain with an InterPro accession IPR001965 as represented by SEQ ID NO: 492.

71. Method according to item 70, wherein said PHD-zf polypeptide further comprises one or more of: (i) a predicted transmembrane domain; (ii) an E/D rich motif; and (iii) a zinc finger with the consensus sequence $CXXC_{8-21}CXXC_4HXXC_{12-46}CXXC$.

72. Method according to item 70 or 71, wherein said PHD-zf polypeptide has in increasing order of preference at least 50%, 55%, 60%, 65%, 70%, 75%, 80%, 85%, 90%, 95%, 98%, 99% or more amino acid sequence identity to a PHD-zf polypeptide as represented by SEQ ID NO: 348.

73. Method according to any one of items 70 to 72, wherein said PHD-zf polypeptide has in increasing order of preference at least 50%, 55%, 60%, 65%, 70%, 75%, 80%, 85%, 90%, 95%, 98%, 99% or more amino acid sequence identity to any of the polypeptide sequences given in Table A4 herein.

74. Method according to any one of items 70 to 73, wherein said nucleic acid sequence encoding a PHD-zf polypeptide is represented by any one of the nucleic acid sequence SEQ ID NOs given in Table A4 or a portion thereof, or a sequence capable of hybridising with any one of the nucleic acid sequences SEQ ID NOs given in Table A4, or to a complement thereof.

75. Method according to any one of items 70 to 74, wherein said nucleic acid sequence encodes an orthologue or paralogue of any of the polypeptide sequence SEQ ID NOs given in Table A4.

76. Method according to any one of items 70 to 75, wherein said increased expression is effected by any one or more of: T-DNA activation tagging, TILLING, or homologous recombination.

77. Method according to any one of items 70 to 76, wherein said increased expression is effected by introducing and expressing in a plant a nucleic acid sequence encoding a PHD-zf polypeptide.

78. Method according to any one of items 70 to 77 wherein said increased seed yield-related trait is one or more of: increased plant height, increased seed fill rate, increased number of flowers per panicles, and increased Thousand Kernel Weight (TKW).

79. Method according to any one of items 70 to 78 wherein said nucleic acid sequence is operably linked to a constitutive promoter.

80. Method according to item 79 wherein said constitutive promoter is a GOS2 promoter, preferably a GOS2 promoter from rice, most preferably a GOS2 sequence as represented by SEQ ID NO: 494.

81. Method according to any one of items 70 to 80, wherein said nucleic acid sequence encoding a PHD-zf polypeptide is from a plant, further preferably from a dicotyledonous plant, more preferably from the family Solanaceae, most preferably the nucleic acid sequence is from *Lycopersicon esculentum*.

82. Plants, parts thereof (including seeds), or plant cells obtainable by a method according to any preceding item, wherein said plant, part or cell thereof comprises an isolated nucleic acid transgene encoding a PHD-zf polypeptide.

83. An isolated nucleic acid molecule selected from:
(i) a nucleic acid sequence as represented by SEQ ID NO: 475, SEQ ID NO: 477, SEQ ID NO: 479, SEQ ID NO: 481, SEQ ID NO: 483, SEQ ID NO: 485, SEQ ID NO: 487, SEQ ID NO: 489;
(ii) the complement of a nucleic acid sequence as represented by SEQ ID NO: 475, SEQ ID NO: 477, SEQ ID NO: 479, SEQ ID NO: 481, SEQ ID NO: 483, SEQ ID NO: 485, SEQ ID NO: 487, SEQ ID NO: 489;
(iii) a nucleic acid sequence encoding a PHD-zf polypeptide having, in increasing order of preference, at least 50%, 55%, 60%, 65%, 70%, 75%, 80%, 85%, 90%, 95%, 96%, 97%, 98%, 99% or more amino acid sequence identity to the polypeptide sequence represented by SEQ ID NO: 348, and having in increasing order of preference at least 50%, 55%, 60%, 65%, 70%, 75%, 80%, 85%, 90%, 95%, 96%, 97%, 98%, 99% or more sequence identity to SEQ ID NO: 491.

84. An isolated polypeptide selected from:
(i) a polypeptide sequence as represented by SEQ ID NO: 476, SEQ ID NO: 478, SEQ ID NO: 480, SEQ ID NO: 482, SEQ ID NO: 484, SEQ ID NO: 486, SEQ ID NO: 488, SEQ ID NO: 490;
(ii) a polypeptide sequence having, in increasing order of preference, at least 50%, 55%, 60%, 65%, 70%, 75%, 80%, 85%, 90%, 95%, 96%, 97%, 98%, 99% or more amino acid sequence identity to a polypeptide sequence as represented by any one of SEQ ID NO: 476, SEQ ID NO: 478, SEQ ID NO: 480, SEQ ID NO: 482, SEQ ID NO: 484, SEQ ID NO: 486, SEQ ID NO: 488, SEQ ID NO: 490;
(iii) derivatives of any of the polypeptide sequences given in (i) or (ii) above.

85. Construct comprising:
(i) a nucleic acid sequence encoding a PHD-zf polypeptide as defined in any one of items 70 to 75, or 83;
(ii) one or more control sequences capable of driving expression of the nucleic acid sequence of (a); and optionally
(iii) a transcription termination sequence.

86. Construct according to item 85, wherein said control sequence is a constitutive promoter.

87. Construct according to item 86, wherein said constitutive promoter is a GOS2 promoter, preferably a GOS2 promoter from rice, most preferably a GOS2 sequence as represented by SEQ ID NO: 494.

88. Use of a construct according to any one of items 85 to 87, in a method for making plants having increased seed yield-related traits relative to control plants, which increased seed yield-related traits are one or more of: increased plant height, increased seed fill rate, increased number of flowers per panicles, and increased Thousand Kernel Weight (TKW).

89. Plant, plant part or plant cell transformed with a construct according to any one of items 85 to 87.

90. Method for the production of transgenic plants having increased seed yield-related traits relative to control plants, comprising:

(i) introducing and expressing in a plant, plant part, or plant cell, a nucleic acid sequence encoding a PHD-zf polypeptide as defined in any one of items 1 to 6, or 14; and
(ii) cultivating the plant cell, plant part, or plant under conditions promoting plant growth and development.

91. Transgenic plant having increased seed yield-related traits relative to control plants, resulting from increased expression of an isolated nucleic acid sequence encoding a PHD-zf polypeptide as defined in any one of items 70 to 75, or 83, or a transgenic plant cell or transgenic plant part derived from said transgenic plant.

92. Transgenic plant according to item 82, 89, or 91, wherein said plant is a crop plant or a monocot or a cereal, such as rice, maize, wheat, barley, millet, rye, triticale, sorghum and oats, or a transgenic plant cell derived from said transgenic plant.

93. Harvestable parts comprising an isolated nucleic acid sequence encoding a PHD-zf polypeptide, of a plant according to item 92, wherein said harvestable parts are preferably seeds.

94. Products derived from a plant according to item 92 and/or from harvestable parts of a plant according to item 93.

95. Use of a nucleic acid sequence encoding a PHD-zf polypeptide as defined in any one of items 70 to 75 in increasing seed yield-related traits, comprising one or more of: increased plant height, increased seed fill rate, increased number of flowers per panicles, and increased Thousand Kernel Weight (TKW).

96. A method for enhancing yield-related traits in plants relative to control plants, comprising modulating expression in a plant of a nucleic acid encoding a REF/ALY (RNA and Export Factor-binding protein) polypeptide and optionally selecting for plants having enhanced seed yield.

97. Method according to item 96, wherein said REF/ALY polypeptide comprises at least one conserved protein motif having in increasing order of preference 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to any one of:
(i) Motif 10 as represented by SEQ ID NO: 540 (SAEDLDADLDKYHS)
(ii) Motif 11 as represented by SEQ ID NO: 541 (LDMSLDDMIAKNRK)
(iii) Motif 12 as represented by SEQ ID NO: 542 (KAPESTWGHDMF)
(iv) Motif 13 as represented by SEQ ID NO: 543 (WQHDMY)
(v) Motif 14 as represented by SEQ ID NO: 544 (KLYISNLDYGV)

98. Method according to item 96 or 97, wherein said modulated expression is effected by introducing and expressing in a plant a nucleic acid encoding a REF/ALY polypeptide.

99. Method according to any one of items 96 to 98, wherein said nucleic acid encoding a REF/ALY polypeptide encodes any one of the proteins listed in Table A5 or is a portion of such a nucleic acid, or a nucleic acid capable of hybridising with such a nucleic acid.

100. Method according to any one of items 96 to 99, wherein said nucleic acid sequence encodes an orthologue or paralogue of any of the proteins given in Table A5.

101. Method according to any one of items 96 to 100, wherein said enhanced yield-related traits comprise increased yield, preferably increased biomass and/or increased seed yield relative to control plants.

102. Method according to any one of items 96 to 101, wherein said enhanced yield-related traits are obtained under non-stress conditions.

103. Method according to any one of items 96 to 101, wherein said enhanced yield-related traits are obtained under conditions of drought stress, salt stress or nitrogen deficiency.

104. Method according to any one of items 98 to 103, wherein said nucleic acid is operably linked to a constitutive promoter, preferably to a GOS2 promoter, most preferably to a GOS2 promoter from rice.

105. Method according to any one of items 96 to 104, wherein said nucleic acid encoding a REF/ALY polypeptide is of plant origin, preferably from a dicotyledonous plant, further preferably from the family Brassicaceae, more preferably from the genus *Arabidopsis*, most preferably from *Arabidopsis thaliana*.

106. Plant or part thereof, including seeds, obtainable by a method according to any one of items 96 to 105, wherein said plant or part thereof comprises a recombinant nucleic acid encoding a REF/ALY polypeptide.

107. An isolated nucleic acid molecule selected from:
   (i) a nucleic acid represented by any one of SEQ ID NO: 505, 507 and 535;
   (ii) the complement of a nucleic acid represented by any one of SEQ ID NO: 505, 507 and 535;
   (iii) a nucleic acid encoding the polypeptide as represented by any one of SEQ ID NO: 506, 508 and 536, preferably as a result of the degeneracy of the genetic code, said isolated nucleic acid can be derived from a polypeptide sequence as represented by any one of SEQ ID NO: 506, 508 and 536 and further preferably confers enhanced yield-related traits relative to control plants;
   (iv) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of table A5 and further preferably conferring enhanced yield-related traits relative to control plants;
   (v) a nucleic acid molecule which hybridizes with a nucleic acid molecule of (i) to (iv) under stringent hybridization conditions and preferably confers enhanced yield-related traits relative to control plants;
   (vi) a nucleic acid encoding an REF/ALY polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 506, 508 and 536 and any of the other polypeptide sequences in Table A5 and preferably conferring enhanced yield-related traits relative to control plants.

108. An amino acid sequence represented by any one of:
   (i) SEQ ID NO: SEQ ID NO: SEQ ID NO: 506, 508 and 536;
   (ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 506, 508 and 536, and any of the other amino acid sequences in Table A5 and preferably conferring enhanced yield-related traits relative to control plants.
   (iii) derivatives of any of the amino acid sequences given in (i) or (ii) above.

109. Construct comprising:
   (i) nucleic acid encoding a REF/ALY polypeptide as defined in items 96 or 97 and/or item 107;
   (ii) one or more control sequences capable of driving expression of the nucleic acid sequence of (a); and optionally
   (iii) a transcription termination sequence.

110. Construct according to item 109, wherein one of said control sequences is a constitutive promoter, preferably a GOS2 promoter, most preferably a GOS2 promoter from rice.

111. Use of a construct according to item 109 or 110 in a method for making plants having increased yield, particularly increased biomass and/or increased seed yield relative to control plants.

112. Plant, plant part or plant cell transformed with a construct according to item 109 or 110.

113. Method for the production of a transgenic plant having increased yield, particularly increased biomass and/or increased seed yield relative to control plants, comprising:
   (i) introducing and expressing in a plant a nucleic acid encoding a REF/ALY polypeptide as defined in item 96 or 97 and/or item 107; and
   (ii) cultivating the plant cell under conditions promoting plant growth and development.

114. Transgenic plant having increased yield, particularly increased biomass and/or increased seed yield, relative to control plants, resulting from modulated expression of a nucleic acid encoding a REF/ALY polypeptide as defined in item 96 or 97 and/or item 107, or a transgenic plant cell derived from said transgenic plant.

115. Transgenic plant according to item 106, 112 or 114, or a transgenic plant cell derived thereof, wherein said plant is a crop plant or a monocot or a cereal, such as rice, maize, wheat, barley, millet, rye, triticale, sorghum emmer, spelt, secale, einkorn, teff, milo and oats.

116. Harvestable parts of a plant according to item 115, wherein said harvestable parts are preferably shoot biomass and/or seeds.

117. Products derived from a plant according to item 115 and/or from harvestable parts of a plant according to item 116.

118. Use of a nucleic acid encoding a REF/ALY polypeptide in increasing yield, particularly in increasing seed yield and/or shoot biomass in plants, relative to control plants.

DESCRIPTION OF FIGURES

The present invention will now be described with reference to the following figures in which:

FIG. 1 represents a multiple alignment of TFL1-like polypeptides. Sequences shown are: Arath_TFL1_like_1 (SEQ ID NO: 2); Poptr_TFL1-like_2 (SEQ ID NO: 18); Poptr_TFL1-like_3 (SEQ ID NO: 20); Solly_TFL1_like_1 (SEQ ID NO: 24); Glyma_TFL1_like_1 (SEQ ID NO: 14);

Poptr_TFL1like_1 (SEQ ID NO: 16); Zeama_TFL1_like_3 (SEQ ID NO: 12); Orysa_TFL1_like_2 (SEQ ID NO: 6); Orysa_TFL1_like_1 (SEQ ID NO: 4); Triae_TFL1_like_1 (SEQ ID NO: 22); Zeama_TFL1_like_1 (SEQ ID NO: 8); Zeama_TFL1_like_2 (SEQ ID NO: 10).

Figure 2:
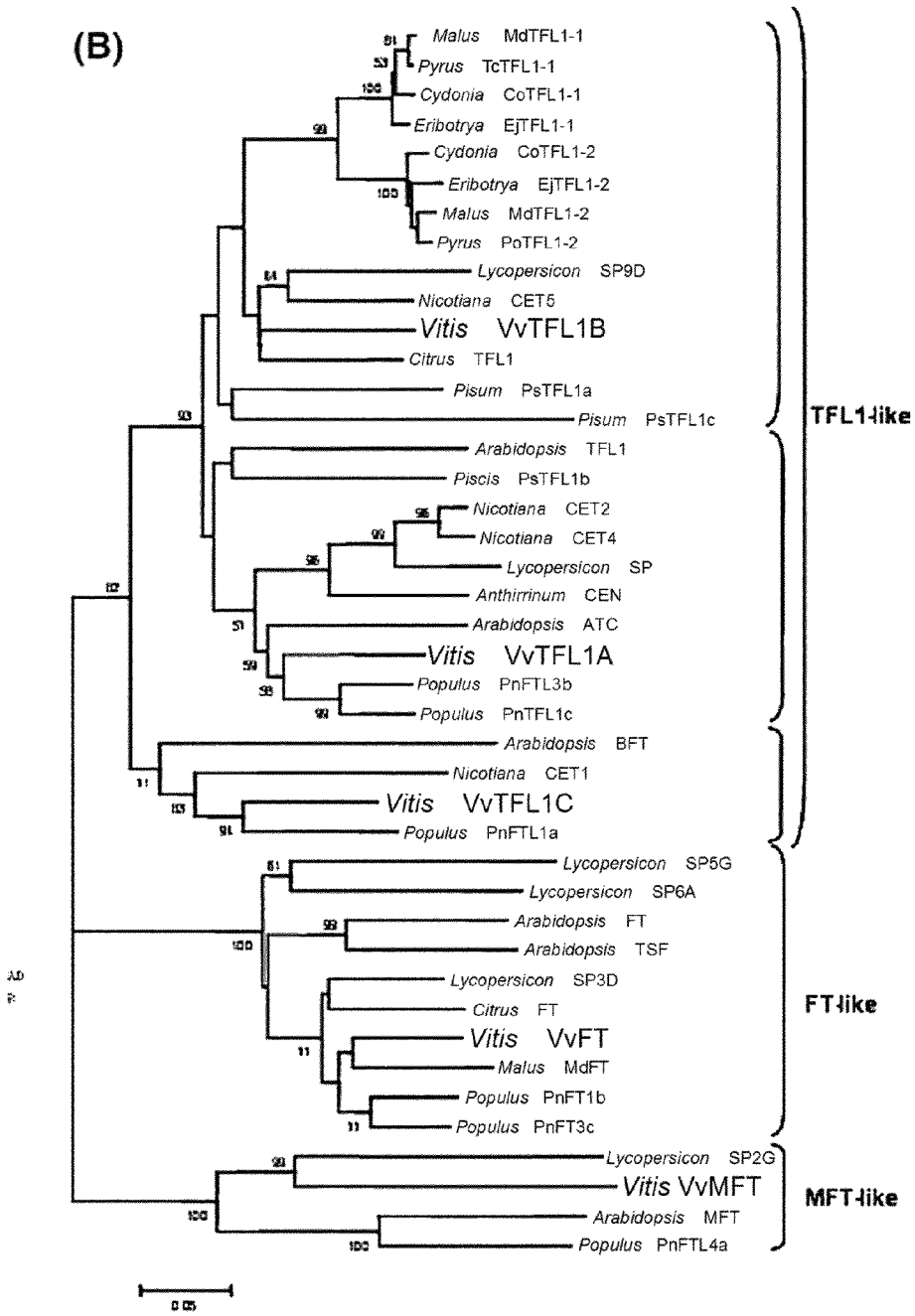

FIG. 2 shows two phylogenetic trees of phosphatidylethanolamine-binding proteins: FIG. 2A: tree according to Carmona et al. 2007, FIG. 2B: tree according to Igasaki et al. 2008.

Figure 3:
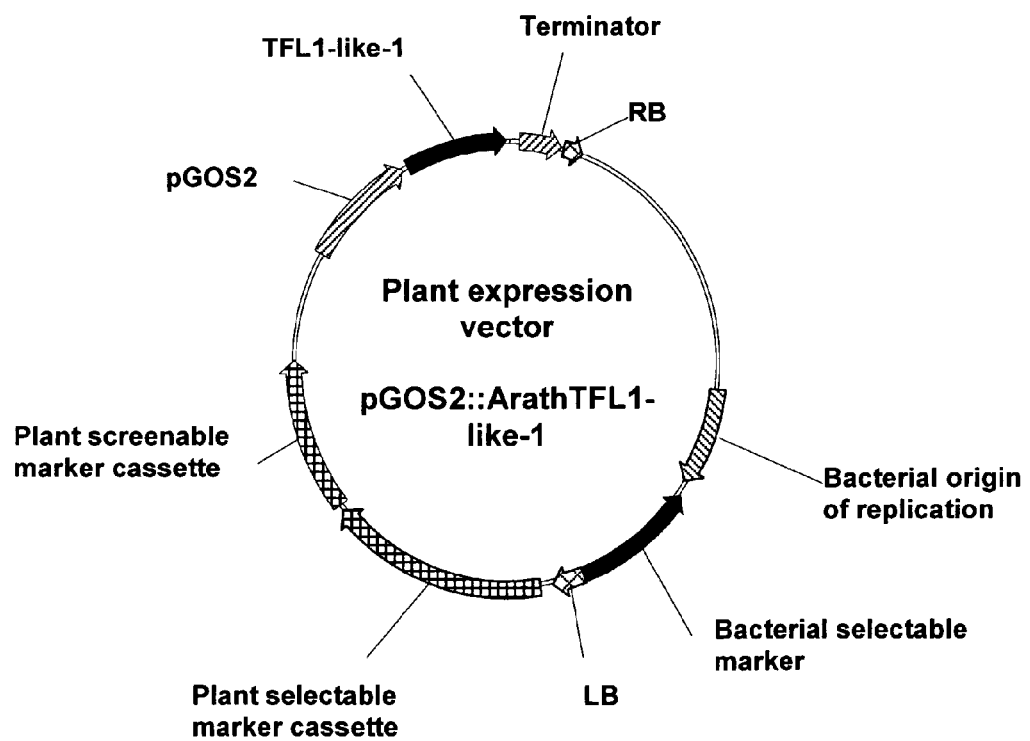

FIG. 3 represents the binary vector for increased expression in *Oryza* sativa of Arath_TFL1_LIKE_1 encoding nucleic acid as represented by SEQ ID NO: 1 or 3 under the control of a rice GOS2 promoter (pGOS2).

FIG. 4 represents a multiple alignment of R5PI polypeptides. Sequences shown are *A.thaliana*_AT1G71100 (SEQ ID NO: 141); *A.thaliana*_AT3G04790 (SEQ ID NO: 145); *G.arboreum*_BG444582 (SEQ ID NO: 149); *G.arboreum*_TA5822 (SEQ ID NO: 151); *G.hirsutum*_TA26611 (SEQ ID NO: 157); *G.hirsutum*_TA28664 (SEQ ID NO: 159); *G.max*_TA40887 (SEQ ID NO: 163); *P.trichocarpa*_70.79 (SEQ ID NO: 177); *P.trichocarpa*_XIII.387 (SEQ ID NO: 185); *S.lycopersicum*_TA38172 (SEQ ID NO: 187); *O.sativa*_Os07g0176900 (SEQ ID NO: 169); *S.officinarum*_TA43377 (SEQ ID NO: 193); *Z.mays*_TA182909 (SEQ ID NO: 203); *C.reinhardtii*_55838 (SEQ ID NO: 147); *P.patens*_133835 (SEQ ID NO: 173); *P.patens*_221767 (SEQ ID NO: 175); *O.tauri*_25759 (SEQ ID NO: 171); *O.sativa*_Os04g0306400 (SEQ ID NO: 167); *S.officinarum*_TA35800 (SEQ ID NO: 191); *Z.mays*_TA181232 (SEQ ID NO: 201); S.officinarum_TA48272 (SEQ ID NO: 192); *Z.mays*_DR791617 (SEQ ID NO: 199); *T.aestivum*_CK211981 (SEQ ID NO: 197); *A.thaliana*_AT2G01290 (SEQ ID NO: 143); *G.hirsutum*_TA22941 (SEQ ID NO: 153); *G.hirsutum*_TA36027 (SEQ ID NO: 161); *G.hirsutum*_TA25911 (SEQ ID NO: 155); *P.trichocarpa*_VIII.1184 (SEQ ID NO: 181); *P.trichocarpa*_X.1083 (SEQ ID NO: 183); *G.max*_TA43617 (SEQ ID NO: 165); *P.trichocarpai*_I.1144 (SEQ ID NO: 179); *S.lycopersicum*_TA43275 (SEQ ID NO: 189).

Figure 5:
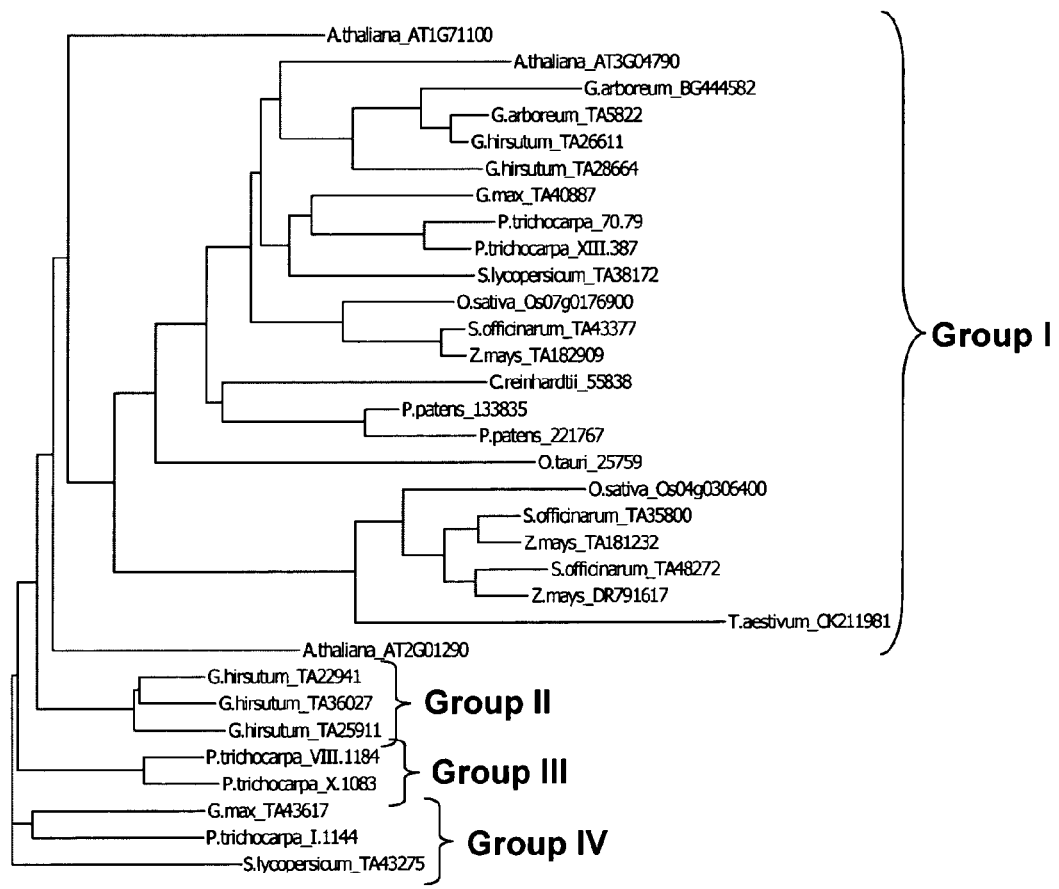

FIG. 5 shows phylogenetic tree of R5PI polypeptides

Figure 6:
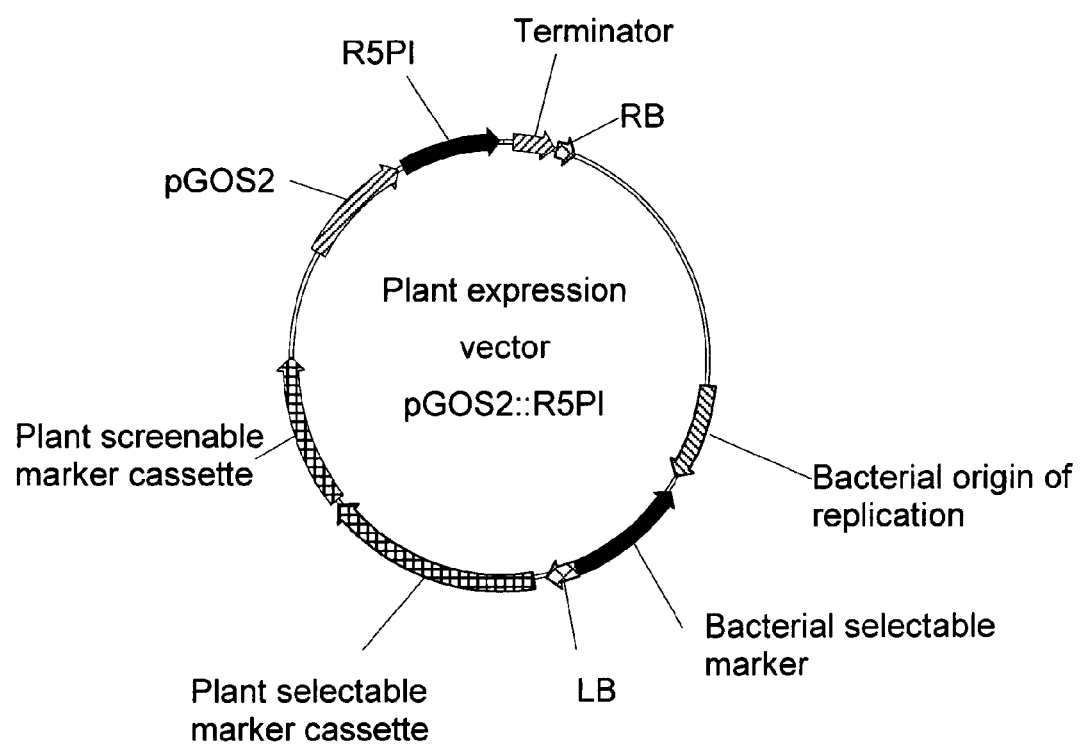

FIG. 6 represents the binary vector for increased expression in *Oryza* sativa of a R5PI-encoding nucleic acid under the control of a rice GOS2promoter (pGOS2)

Figure 7:
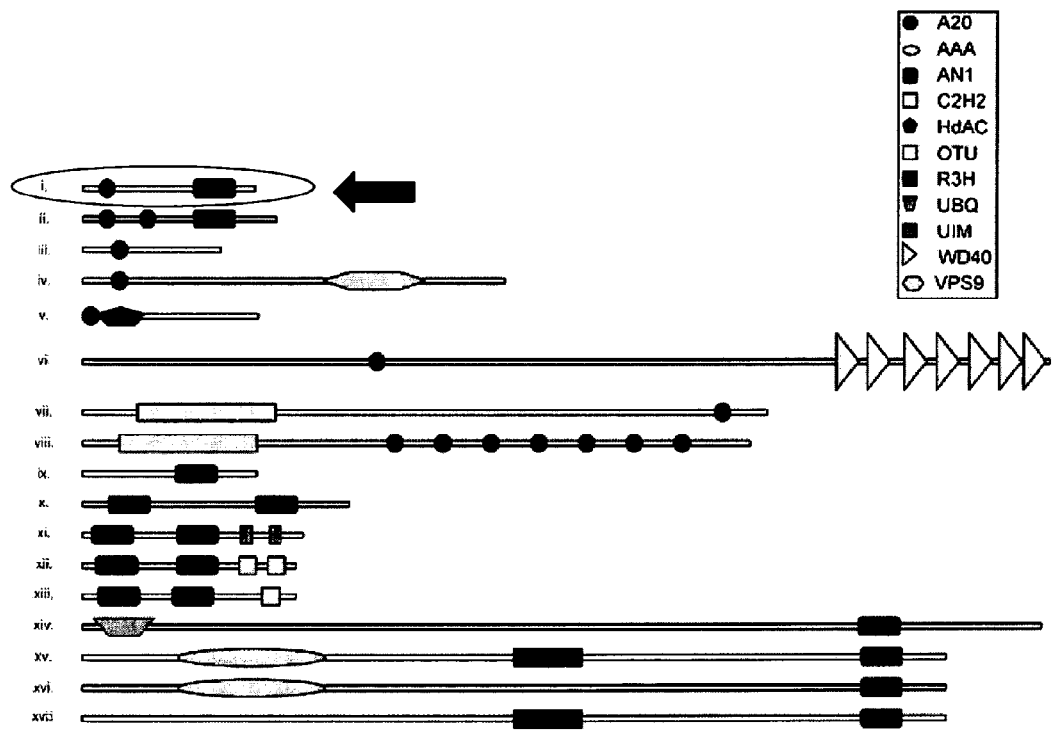

FIG. 7 represents the domain organisation of Znf A20/AN1 polypeptides, according to Vij & Tyagi (2008) Funct Integr Genomics). The authors distinguish seventeen classes of Znf polypeptides, amongst which class I polypeptides comprising at least a A20-zinc finger domain and at least an AN1-zinc finger domain. This class is circled in the figure, and marked by a black arrow.

Figure 8:
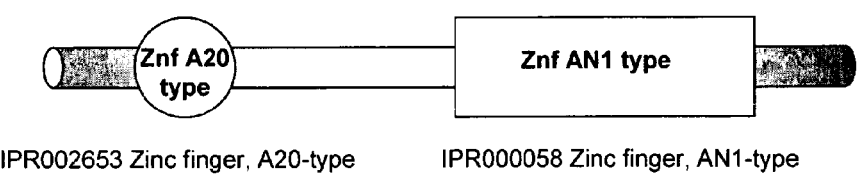

FIG. 8 represents a cartoon of a Znf A20/AN1 polypeptide as represented by SEQ ID NO: 213 or by SEQ ID NO: 215, which comprises (i) at least one A20-type zinc finger domain with an InterPro accession IPR002653 (ProSite accession PS51036); and (ii) at least one AN1-type zinc finger domain with an InterPro accession IPR000058 (ProSite accession PS51039).

Figure 9:
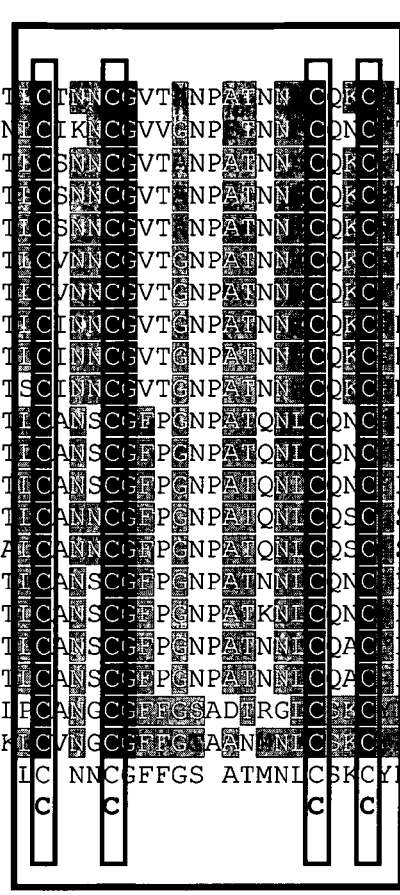
Figure 9:
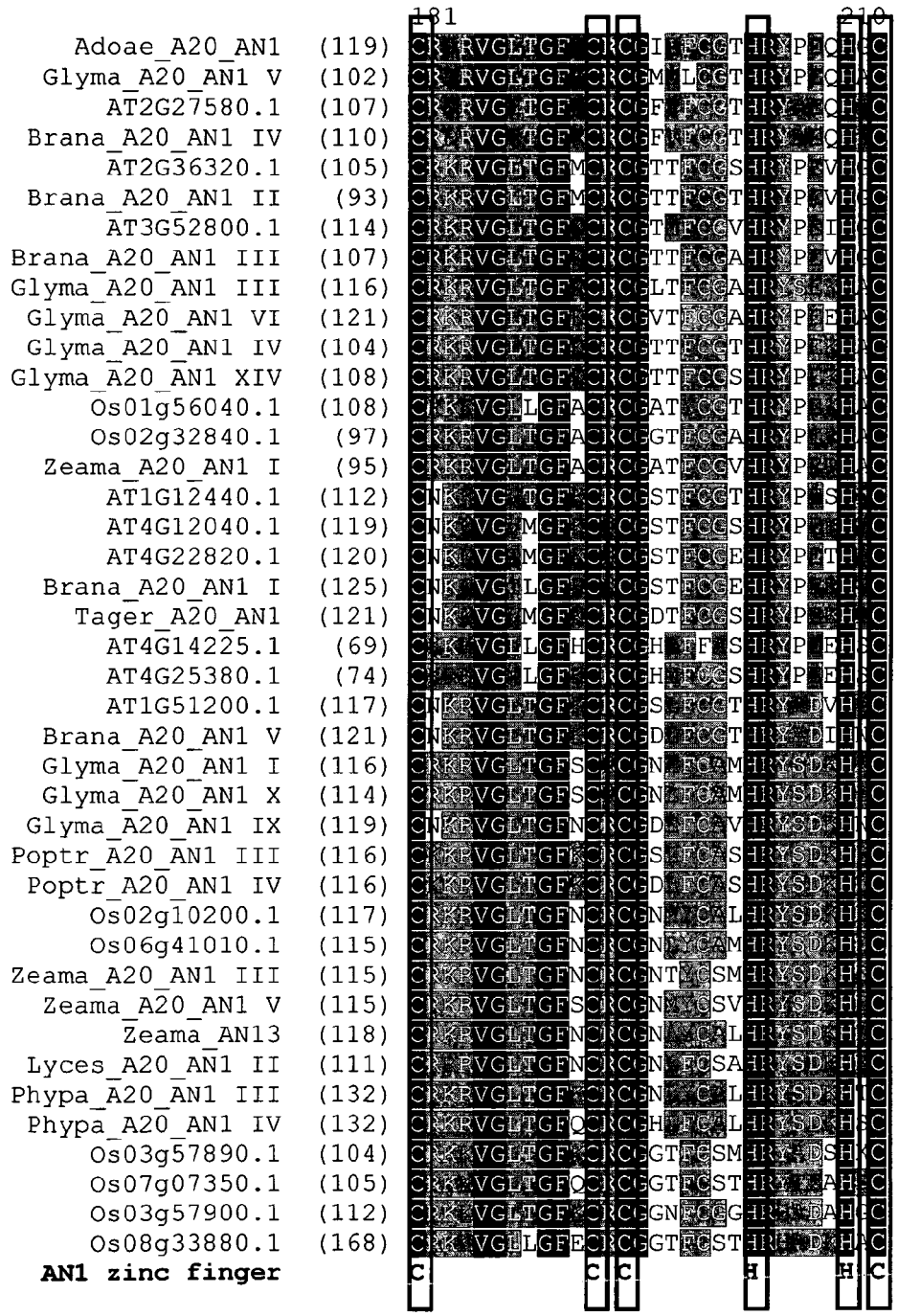

FIG. 9 shows an AlignX (from Vector NTI 10.3, Invitrogen Corporation) multiple sequence alignment of the Znf A20/AN1 polypeptides from Table A3. The conserved Cys residues of the A20 zinc finger domain are marked in black, boxed vertically and are also identified at the bottom of the alignment, as are the conserved Cys and His residues of the AN1 zinc finger domain. The A20 zinc finger domain (as represented by SEQ ID NO: 338 (comprised in SEQ ID NO: 213) and by SEQ ID NO: 339 (comprised in SEQ ID NO: 215) is heavily boxed across the aligned polypeptides. The AN1 zinc finger domain (as represented by SEQ ID NO: 340 (comprised in SEQ ID NO: 213) and by SEQ ID NO: 341 (comprised in SEQ ID NO: 215) is also heavily boxed across the aligned polypeptides. Sequences shown are: Adoae_A20_AN1 (SEQ ID NO: 281); Glyma_A20_AN1 V (SEQ ID NO: 305); AT2G27580.1 (SEQ ID NO: 221); Brana_A20_AN1 IV (SEQ ID NO: 289); AT2G36320.1 (SEQ ID NO: 223); Brana_A20_AN1 II (SEQ ID NO: 285); AT3G52800.1 (SEQ ID NO: 225); Brana_A20_AN1 III (SEQ ID NO: 287); Glyma_A20_AN1 III (SEQ ID NO: 301); Glyma_A20_AN1 VI (SEQ ID NO: 307); Glyma_A20_AN1 IV (SEQ ID NO: 303); Glyma_A20_AN1 XIV (SEQ ID NO: 313); Os01g56040.1 (SEQ ID NO: 241); Os02g32840.1 (SEQ ID NO: 245); Zeama_A20_AN1 I (SEQ ID NO: 329); AT1G12440.1 (SEQ ID NO: 217); AT4G12040.1 (SEQ ID NO: 227); AT4G22820.1 (SEQ ID NO: 231); Brana_A20_AN1 I (SEQ ID NO: 283); Tager_A20_AN1 (SEQ ID NO: 325); AT4G14225.1 (SEQ ID NO: 229); AT4G25380.1 (SEQ ID NO: 233); AT1G51200.1 (SEQ ID NO: 219); Brana_A20_AN1 V (SEQ ID NO: 291); Glyma_A20_AN1 I (SEQ ID NO: 299); Glyma_A20_AN1 X (SEQ ID NO: 311); Glyma_A20_AN1 IX (SEQ ID NO:309); Poptr_A20_AN1 III (SEQ ID NO: 265); Poptr_A20_AN1 IV SEQ ID NO: 267); Os02g10200.1 (SEQ ID NO: 243); Os06g41010.1 (SEQ ID NO: 251); Zeama_A20_AN1 III (SEQ ID NO: 333); Zeama_A20_AN1 V (SEQ ID NO: 337); Zeama_AN—(SEQ ID NO: 277); Lyces_A20_AN1 II (SEQ ID NO: 237); Phypa_A20_AN1 III (SEQ ID NO: 321); Phypa_A20_AN1 IV (SEQ ID NO: 323); Os03g57890.1 (SEQ ID NO: 247); Os07g07350.1 (SEQ ID NO: 253); Os03g57900.1 (SEQ ID NO: 249D; Os08g33880.1 (SEQ ID NO: 255); AT3G12630.1 (SEQ ID NO: 213); Medtr_A20_AN1 (SEQ ID NO: 215); Brana_A20_AN1 VI (SEQ ID NO: 293); Brana_A20_AN1 VII (SEQ ID NO: 295); Brana_A20_AN1 VIII (SEQ ID NO: 297); Glyma_A20_AN1 XV (SEQ ID NO: 315); Glyma_A20_AN1 XVI (SEQ ID NO: 313); Lyces_A20_AN1 (SEQ ID NO: 235); Poptr_A20_AN1 (SEQ ID NO: 261); Poptr_A20_AN1 II (SEQ ID NO: 263); Horvu_A20_AN1 (SEQ ID NO: 319); Triae_A20_AN1 I (SEQ ID NO: 327); Os09g31200.1 (SEQ ID NO: 259); Zeama_A20_AN1 II (SEQ ID NO: 331); Zeama_AN15 (SEQ ID NO: 279); Os08g39450.1 (SEQ ID NO: 257); Triae_A20_AN1 II (SEQ ID NO: 327); Zeama_A20_AN1 IV (SEQ ID NO: 335); Zeama_AN110 (SEQ ID NO: 275); Os01g52030.1 (SEQ ID NO: 239); Poptr_A20_AN1 V (SEQ ID NO: 269).

Figure 10:
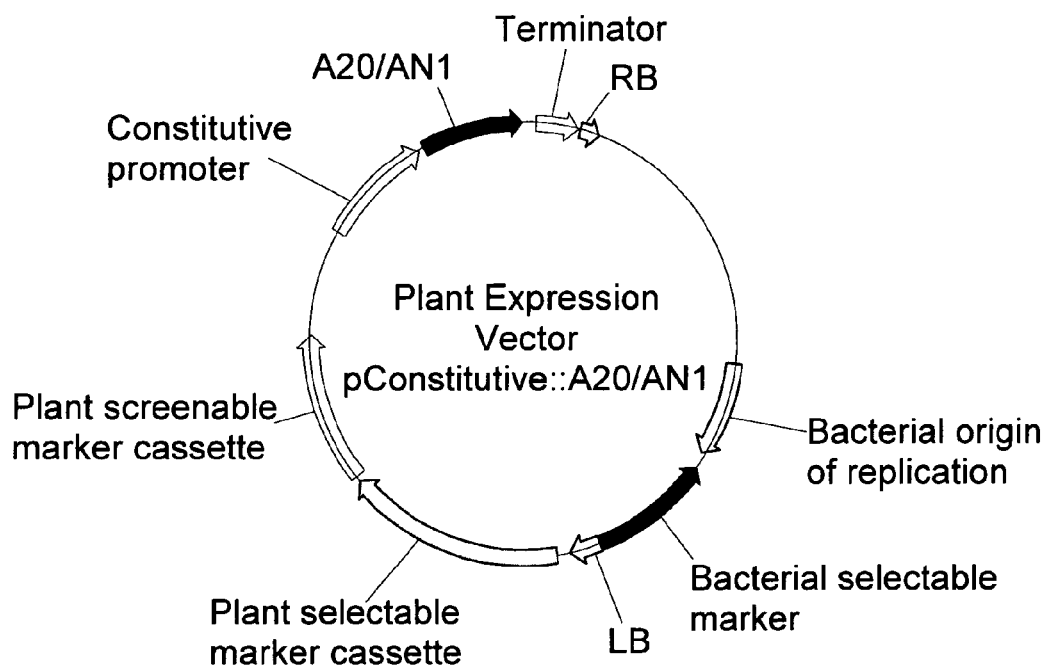

FIG. 10 shows the binary vector for increased expression in *Oryza sativa* of a nucleic acid sequence encoding a Znf A20/AN1 polypeptide under the control of a constitutive promoter (pGOS2) from rice.

Figure 11:
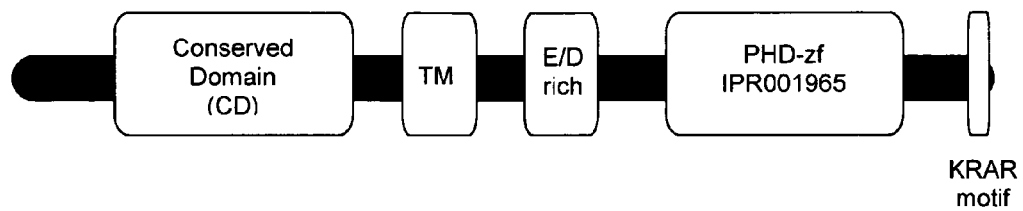

FIG. 11 represents a cartoon of a PHD-zf polypeptide as represented by SEQ ID NO: 348, which comprises the following features: a Conserved Domain, as represented by SEQ ID NO: 491(comprised in SEQ ID NO: 2), a TMHMM predicted transmembrane domain, an E/D rich motif, a PHD-zf with InterPro accession number IPRO01965, and a KRAR motif.

Figure 12:
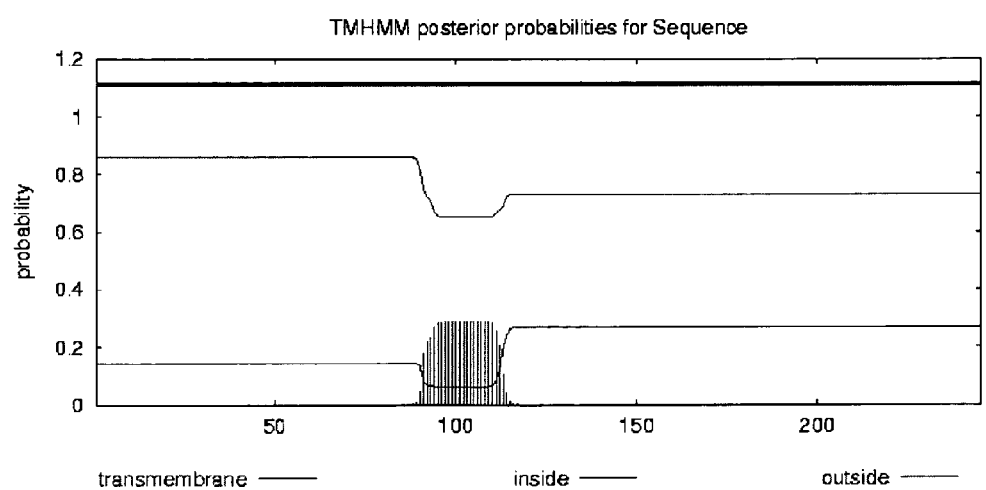

FIG. 12 represents the graphical output of the algorithm TMHMM for SEQ ID NO: 348, ofr prediction of transmembrane domains. From the algorithm prediction using SEQ ID NO: 348, a transmembrane domain is predicted between the Conserved Domain (CD) and the PHD-zf domain with InterPro accession number IPRO01965.

Figure 13:
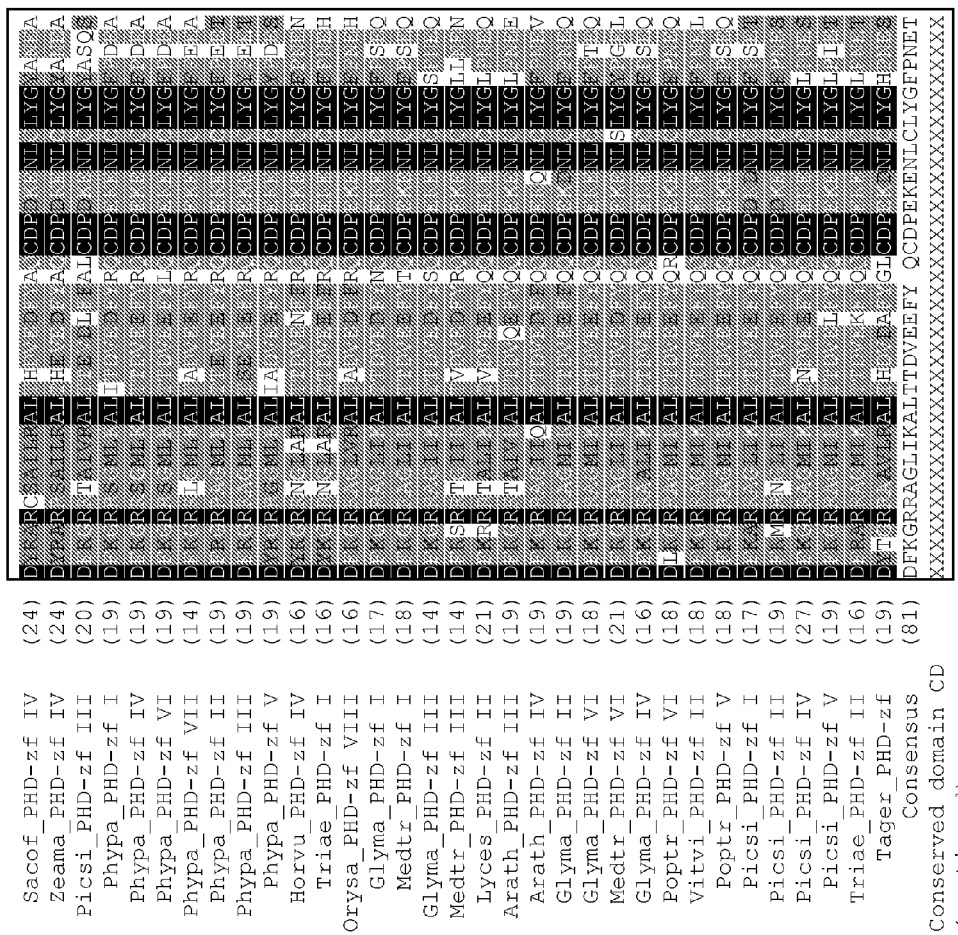
Figure 13:
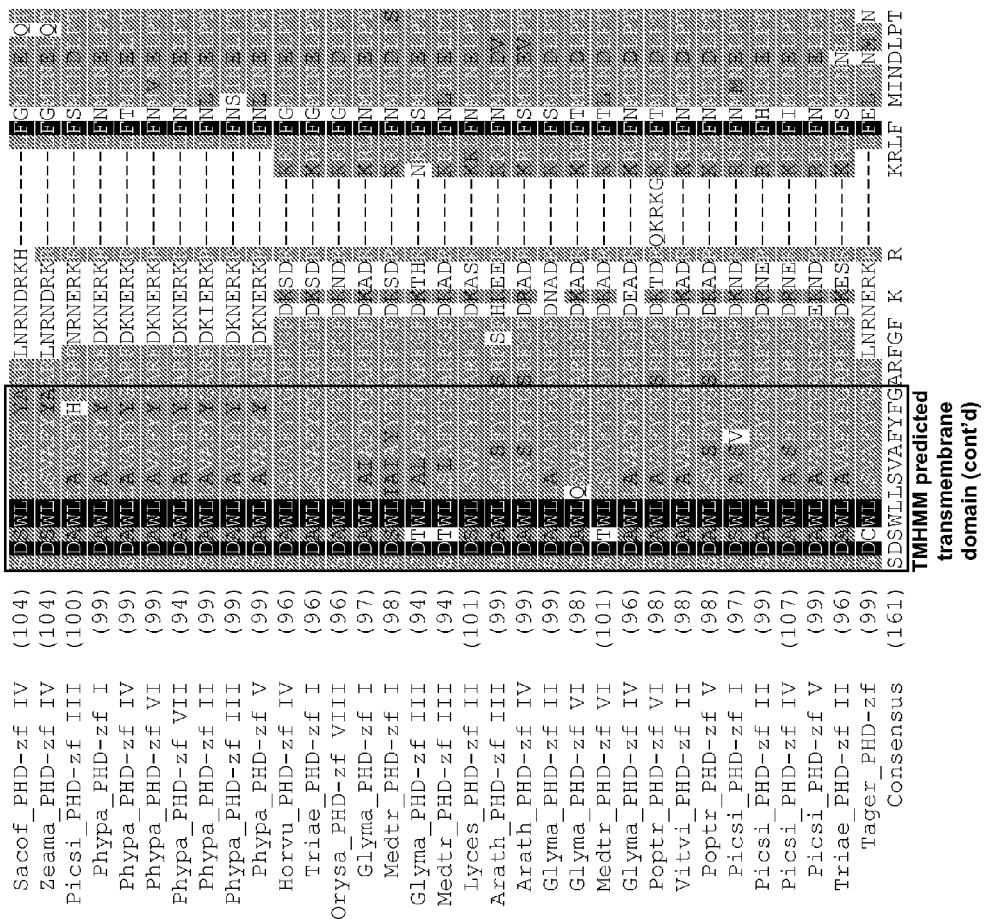
Figure 13:
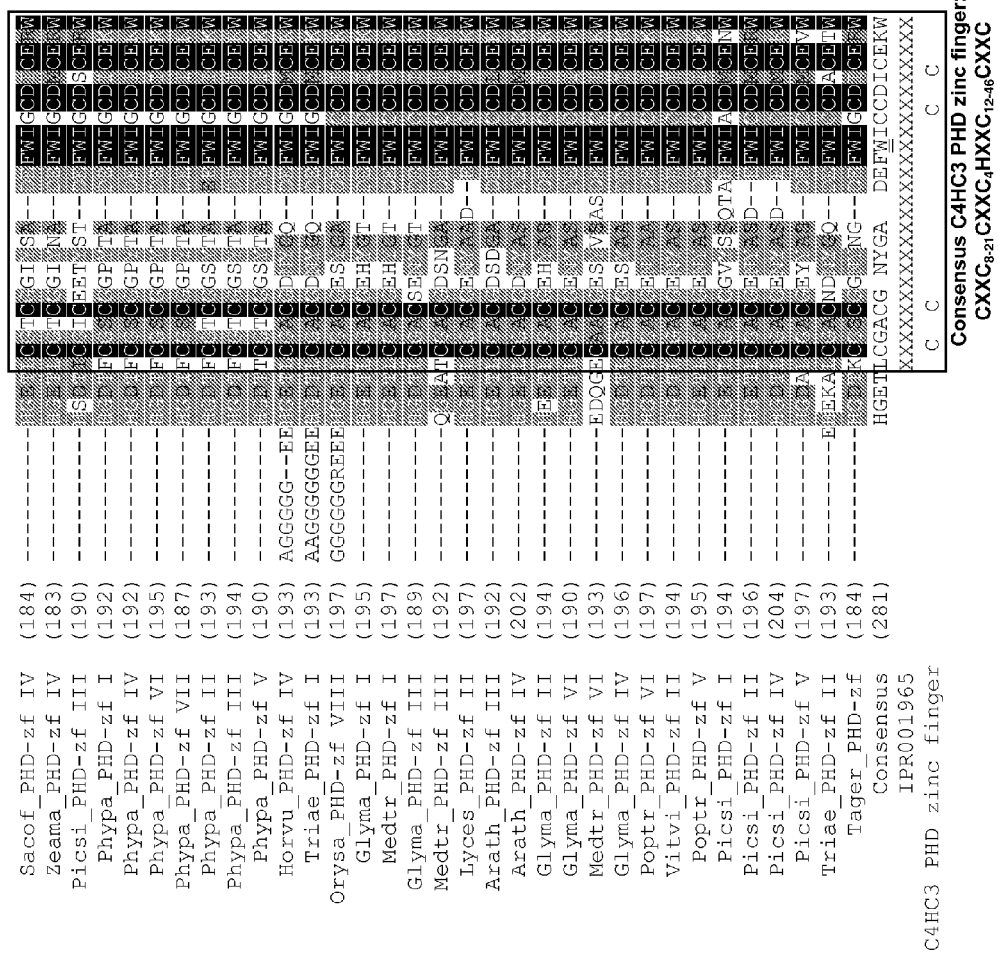
Figure 13:
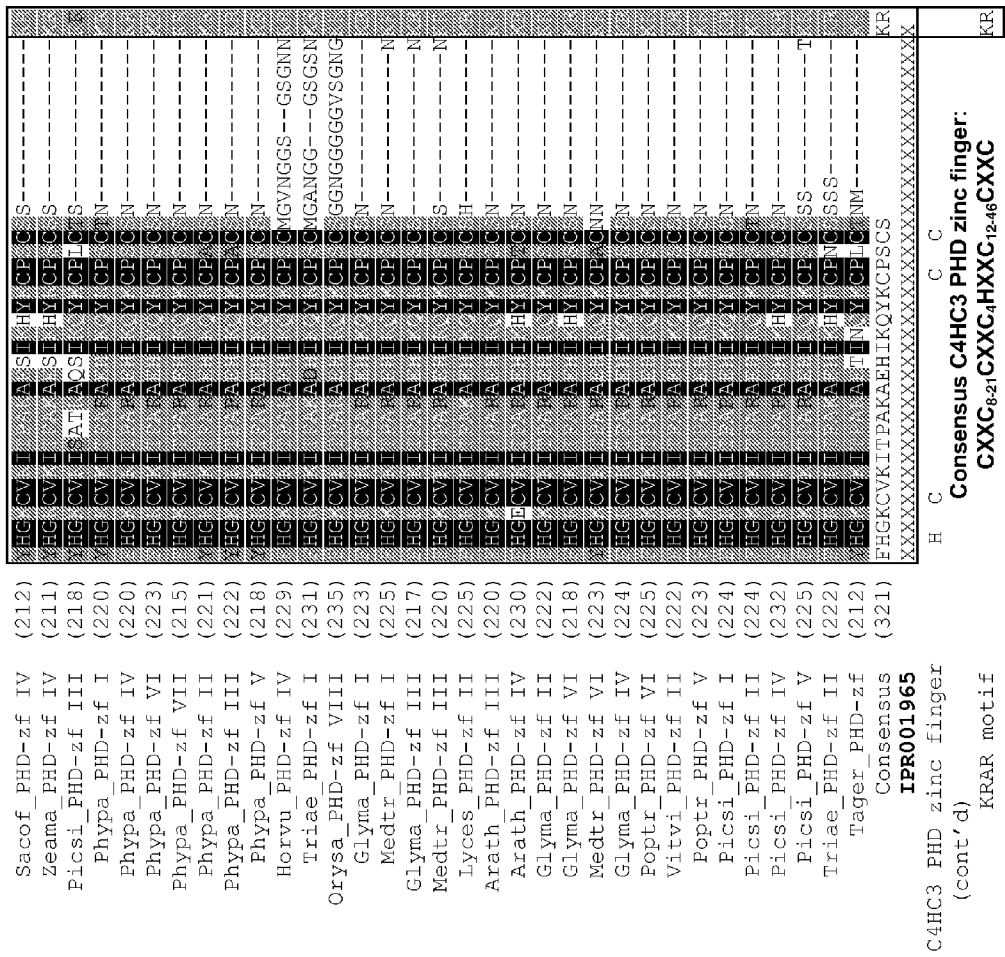
Figure 13:
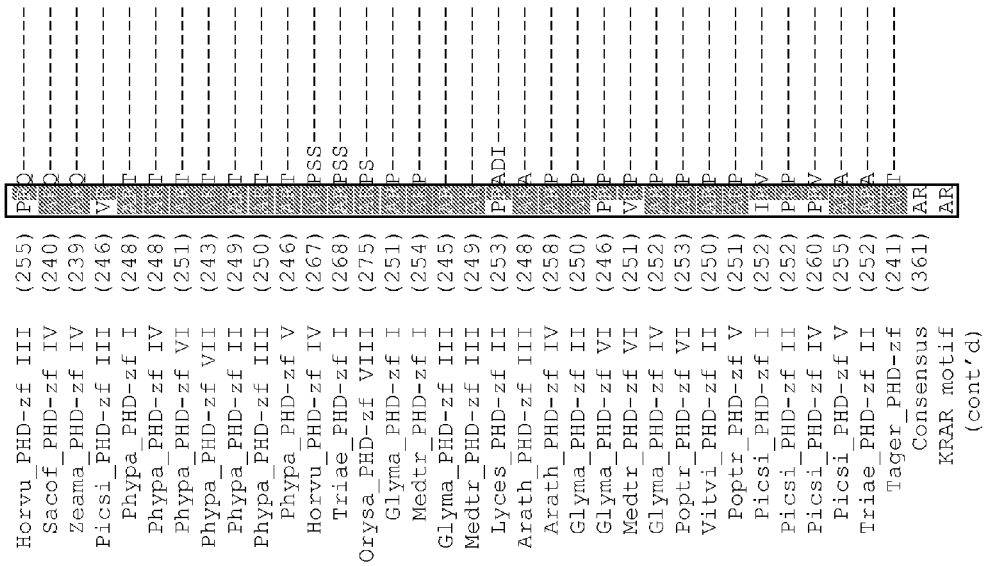

FIG. 13 shows an AlignX (from Vector NTI 10.3, Invitrogen Corporation) multiple sequence alignment of the PHD-zf polypeptides from Table A4. The Conserved Domain (CD)

and the PHD-zf IPR001965 are boxed and marked with X's under the consensus sequence line, the predicted TMHMM, the E/D rich motif and KRAR motif are also boxed. The conserved W (Trp) within the PHD-zf is double-underlined. Sequences shown are: Arath PHD-zf I (SEQ ID NO: 350); Glyma_PHD-zf V (SEQ ID NO: 370); Medtr_PHD-zf V (SEQ ID NO: 388); Poptr_PHD-zf VII (SEQ ID NO: 434); Poptr_PHD-zf VIII (SEQ ID NO: 436); Vitvi_PHD-zf IV (SEQ ID NO: 466); Lyces_PHD-zf III (SEQ ID NO: 378); Orysa_PHD-zf I (SEQ ID NO: 392); Horvu_PHD-zf I (SEQ ID NO: 374); Orysa_PHD-zf VI (SEQ ID NO: 402); Sacof PHD-zf III (SEQ ID NO: 454); Zeama_PHD-zf II (SEQ ID NO: 470); Horvu_PHD-zf II (SEQ ID NO: 478); Orysa_PHD-zf IX (SEQ ID NO: 408); Sacof_PHD-zf II (SEQ ID NO: 452); Orysa_PHD-zf II (SEQ ID NO: 394); Zeama_PHD-zf I (SEQ ID NO: 468); Oyrsa_PHD-zf IV (SEQ ID NO: 398); Arath_PHD-zf II (SEQ ID NO: 352); Arath_PHD-zf V (SEQ ID NO: 358); Glyma _PHD-zf VII (SEQ ID NO: 482); Medtr_PHD-zf IV (SEQ ID NO: 386); Poptr_PHD-zf II (SEQ ID NO: 424); Poptr_PHD-zf III (SEQ ID NO: 426); Vitivi_PHD-zf I (SEQ ID NO: 460); Lyces_PHD-zf IV (SEQ ID NO: 380); Poptr_PHD-zf I (SEQ ID NO: 422); Poptr_PHD-zf IV (SEQ ID NO: 428); Roshy_PHD-zf (SEQ ID NO: 410); Vitvi_PHD-zf III (SEQ ID NO: 464); Orysa_PHD-zf III (SEQ ID NO: 396); Sacof_PHD-zf V (SEQ ID NO: 458); Orysa_PHD-zf VII (SEQ ID NO: 404); Zeama_PHD-zf III (SEQ ID NO: 472); Lyces_PHD-zf* I (SEQ ID NO: 348); Orysa_PHD-zf IV (SEQ ID NO: 398); Horvu_PHD-zf III (SEQ ID NO: 480); Sacof_PHD-zf IV (SEQ ID NO: 456); Zeama_PHD-zf IV (SEQ ID NO: 474); Picsi_PHD-zf III (SEQ ID NO: 416); Phypa_PHD-zf I (SEQ ID NO: 438); Phypa_PHD-zf IV (SEQ ID NO: 444); Phypa_PHD-zf VI (SEQ ID NO: 448); Phypa_PHD-zf VII (SEQ ID NO: 450); Phypa_PHD-zf II (SEQ ID NO: 440) Phypa_PHD-zf III (SEQ ID NO: 442); Phypa_PHD-zf V (SEQ ID NO: 446); Horvu_PHD-zf IV (SEQ ID NO: 374); Triae_PHD-zf I (SEQ ID NO: 488); Orysa_PHD-zf VIII (SEQ ID NO: 406); Glyma_PHD-zf I (SEQ ID NO: 362); Medtr_PHD-zf I (SEQ ID NO: 382); Glyma_PHD-zf III (SEQ ID NO: 366); Medtr_PHD-zf III (SEQ ID NO: 384); Lyces_PHD-zf II (SEQ ID NO: 376); Arath_PHD-zf III (SEQ ID NO: 354); Arath_PHD-zf IV (SEQ ID NO: 356); Glyma_PHD-zf II (SEQ ID NO: 364); Glyma_PHD-zf VI (SEQ ID NO: 372); Medtr_PHD-zf VI (SEQ ID NO: 390); Glyma_PHD-zf IV (SEQ ID NO: 368); Poptr_PHD-zf VI (SEQ ID NO: 432); Vitvi_PHD-zf II (SEQ ID NO: 462); Poptr_PHD-zf V (SEQ ID NO: 430); Picsi_PHD-zf I (SEQ ID NO: 412); Picsi_PHD-zf II (SEQ ID NO: 414); Picsi_PHD-zf IV (SEQ ID NO: 418); Picsi_PHD-zf V (SEQ ID NO: 420); Triae_PHD-zf II (SEQ ID NO: 490); Tager_PHD-zf (SEQ ID NO: 486).

Figure 14:
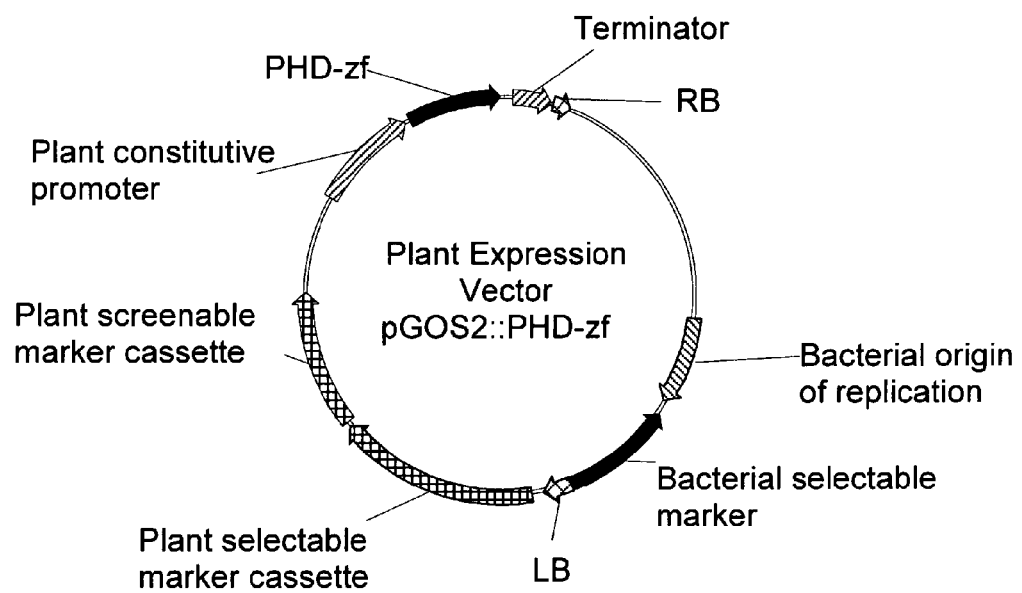

FIG. 14 shows the binary vector for increased expression in *Oryza sativa* plants of a nucleic acid sequence encoding a PHD-zf polypeptide under the control of a promoter functioning in plants.

FIG. 15 represents multiple alignments of REF/ALY polypeptides. The position of Motifs 10 to 14 and equivalent Motifs in other REF/ALY polypeptides is highlighted over the consensus sequence. The RRM domain in the consensus sequence is boxed. Sequences shown are: A.thaliana_At5g59950(SEQ ID NO: 498); A.thaliana_AT5G59950 (SEQ ID NO: 504); H.vulgare_BF2629051 (SEQ ID NO: 510); H.vulgare_TA34369_45131 (SEQ ID NO: 512); T.aestivum_(SEQ ID NO: 530); T.aestivum_TA72566_45651 (SEQ ID NO: 534); T.aestivum_TA72565_45651 (SEQ ID NO: 532); O.sativa_Os03g0278300 (SEQ ID NO: 520); Z.mays_ZM07MC203651 (SEQ ID NO: 536); Z_mays_AY104617 (SEQ ID NO: 538); G.max_GM06MC115191 (SEQ ID NO: 506); M.truncatula_BG5813671 (SEQ ID NO: 514); M.truncatula_TA20993_38801 (SEQ ID NO: 516); G.max GM06MC147591 (SEQ ID NO: 508); P.trichocarpa_scaff_I.16411 (SEQ ID NO: 524); N.tabacum_CAG26903.1 (SEQ ID NO: 518); S.lycopersicum_AW9285861 (SEQ ID NO: 526); S.lycopersicum_TA41256_40811 (SEQ ID NO: 528); N.tabacum_CAG26902.1 (SEQ ID NO: 500); N.tabacum_CAJ44457.1 (SEQ ID NO: 502); P.trichocarpa_scaff_226.111 (SEQ ID NO: 522).

Figure 16:
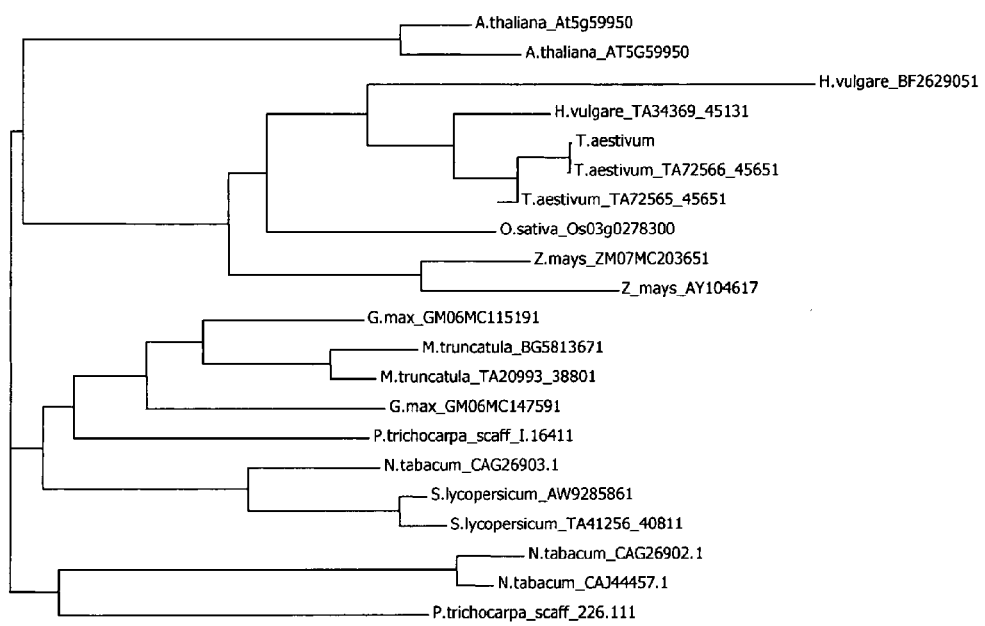

FIG. 16 shows a phylogenetic tree of REF/ALY polypeptides.

Figure 17:
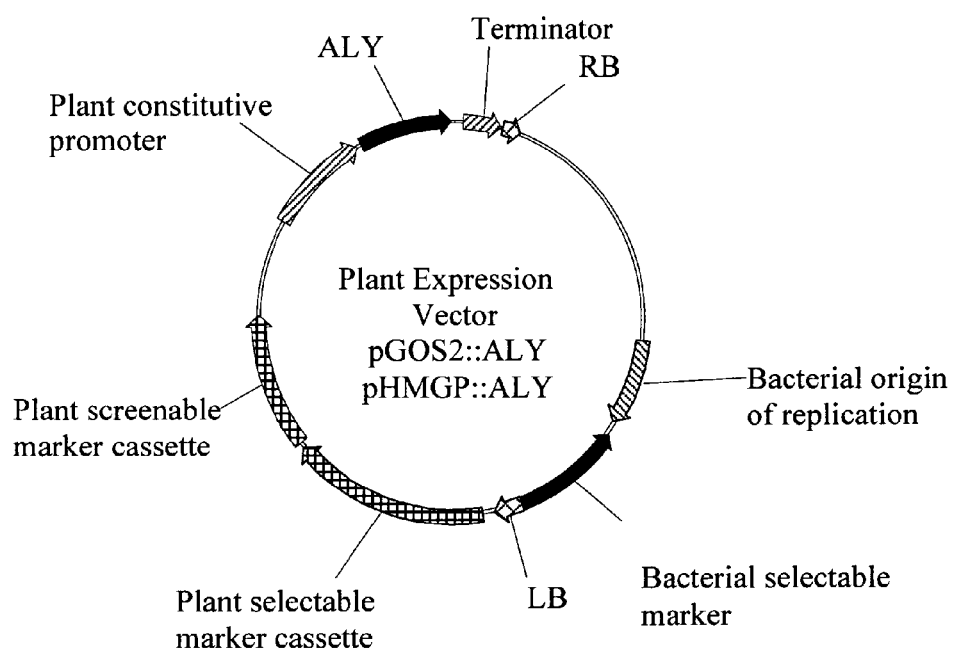

FIG. 17 represents the binary vector for increased expression in *Oryza sativa* of a REF/ALY-encoding nucleic acid under the control of a rice GOS2 promoter (pGOS2) or a rice HMGP promoter (pHMGP).

EXAMPLES

The present invention will now be described with reference to the following examples, which are by way of illustration alone. The following examples are not intended to completely define or otherwise limit the scope of the invention.

DNA manipulation: unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

Example 1

Identification of Sequences Related to the Nucleic Acid Sequence Used in the Methods of the Invention Sequences (full length cDNA, ESTs or genomic) related to the nucleic acid sequence used in the methods of the present invention were identified amongst those maintained in the Entrez Nucleotides database at the National Center for Biotechnology Information (NCBI) and other sequence databases using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. For example, the polypeptide encoded by the nucleic acid used in the present invention was used for the TBLASTN algorithm, with default settings and the filter to ignore low complexity sequences set off. The output of the analysis was viewed by pairwise comparison, and ranked according to the probability score (E-value), where the score reflect the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length.

1.1. TFL1-Like Polypeptides

Table A1 provides a list of TFL1-like nucleic acid sequences and encoded polypeptides thereof useful in the methods of the present invention.

TABLE A1

Examples of TFL1-like nucleic acids and their encoded polypeptides:

| NAME | Nucleic acid SEQ ID NO: | Polypeptide SEQ ID NO: |
|---|---|---|
| Arath_TFL1_like | 1 | 2 |
| Orysa_TFL1_like_1 | 3 | 4 |
| Orysa_TFL1_like_2 | 5 | 6 |
| Zeama_TFL1_like_1 | 7 | 8 |
| Zeama_TFL1_like_2 | 9 | 10 |
| Zeama_TFL1_like_3 | 11 | 12 |
| Glyma_TFL1_like_1 | 13 | 14 |
| Poptr_TFL1-like_1 | 15 | 16 |
| Poptr_TFL1-like_2 | 17 | 18 |
| Poptr_TFL1-like_3 | 19 | 20 |
| Triae_TFL1_like_1 | 21 | 22 |
| Solly_TFL1_like_1 | 23 | 24 |
| P.trichocarpa_575797_BFT | 25 | 26 |
| A.majus_AJ802379 | 27 | 28 |
| A.thaliana_BFT_AT5G62040 | 29 | 30 |
| B.napus_BN06MC04018_42203942@4009 | 31 | 32 |
| C.solstitialis_EH787691 | 33 | 34 |
| G.max_Glyma09g26550.1 | 35 | 36 |
| G.max_Glyma16g32080.1 | 37 | 38 |
| H.annuus_DY918510 | 39 | 40 |
| H.tuberosus_EL460602 | 41 | 42 |
| M.domestica_TC3972 | 43 | 44 |
| M.truncatula_AC146807_6.4 | 45 | 46 |
| N.tabacum_TC37788 | 47 | 48 |
| S.tuberosum_TC184616 | 49 | 50 |
| T.erecta_SIN_31b-CS_SCR28-H22.b2---------@7054 | 51 | 52 |
| V.vinifera_GSVIVT00007370001 | 53 | 54 |
| B.napus_ES903789 | 55 | 56 |
| C.annuum_TC8401 | 57 | 58 |
| C.solstitialis_EH782629 | 59 | 60 |
| E.esula_DV157402 | 61 | 62 |
| L.saligna_DW073438 | 63 | 64 |
| M.domestica_TC11859 | 65 | 66 |
| N.tabacum_TC22106 | 67 | 68 |
| S.tuberosum_TC167458 | 69 | 70 |
| A.thaliana_TFL1_AT5G03840 | 71 | 72 |
| B.napus_EV057528 | 73 | 74 |
| B.napus_TC86085 | 75 | 76 |
| F.arundinacea_DT710154 | 77 | 78 |
| G.max_Glyma03g35250.1 | 79 | 80 |
| G.max_Glyma10g08340.1 | 81 | 82 |
| G.max_Glyma13g22030.1 | 83 | 84 |
| G.max_Glyma19g37890.1 | 85 | 86 |
| H.vulgare_TC185326 | 87 | 88 |
| L.japonicus_NP863984 | 89 | 90 |
| M.truncatula_AC147007_3.4 | 91 | 92 |
| O.sativa_LOC_Os02g32950.1 | 93 | 94 |
| O.sativa_LOC_Os04g33570.1 | 95 | 96 |
| O.sativa_LOC_Os11g05470.1 | 97 | 98 |
| S.bicolor_Sb04g021650.1 | 99 | 100 |
| S.bicolor_Sb05g003200.1 | 101 | 102 |
| S.bicolor_Sb06g015490.1 | 103 | 104 |
| S.bicolor_Sb08g003210.1 | 105 | 106 |
| S.officinarum_CF571229 | 107 | 108 |
| Z.mays_NP13046728 | 109 | 110 |
| Z.mays_NP13046729 | 111 | 112 |
| Z.mays_NP13046731 | 113 | 114 |
| Z.mays_TC388266 | 115 | 116 |
| Z.mays_ZM07MC02424_58551053@2416 | 117 | 118 |

1.2. Ribose 5-Phosphate Isomerase (R5PI)

Table A2 provides a list of nucleic acid sequences related to the nucleic acid sequence used in the methods of the present invention.

TABLE A2

Examples of R5PI nucleic acids and polypeptides:

| Name | Source organism | Nucleic Acid SEQ ID NO: | Polypeptide SEQ ID NO: |
|---|---|---|---|
| A.thaliana_AT1G71100 | Arabidopsis thaliana | 140 | 141 |
| A.thaliana_AT2G01290 | Arabidopsis thaliana | 142 | 143 |
| A.thaliana_AT3G04790 | Arabidopsis thaliana | 144 | 145 |
| C.reinhardtii_55838 | Chlamydomonas reinhardtii | 146 | 147 |
| G.arboreum_BG444582 | Gossypium arboretum | 148 | 149 |
| G.arboreum_TA5822 | Gossypium arboretum | 150 | 151 |
| G.hirsutum_TA22941 | Gossypium hirsutum | 152 | 153 |
| G.hirsutum_TA25911 | Gossypium hirsutum | 154 | 155 |
| G.hirsutum_TA26611 | Gossypium hirsutum | 156 | 157 |
| G.hirsutum_TA28664 | Gossypium hirsutum | 158 | 159 |
| G.hirsutum_TA36027 | Gossypium hirsutum | 160 | 161 |
| G.max_TA40887 | Glycine max | 162 | 163 |
| G.max_TA43617 | Glycine max | 164 | 165 |
| O.sativa_Os04g0306400 | Oryza sativa | 166 | 167 |
| O.sativa_Os07g0176900 | Oryza sativa | 168 | 169 |
| O.tauri_25759 | Ostreococus tauri | 170 | 171 |
| P.patens_133835 | Physcomitrella patens | 172 | 173 |
| P.patens_221767 | Physcomitrella patens | 174 | 175 |
| P.trichocarpa_70.79 | Populus trichocarpa | 176 | 177 |
| P.trichocarpa_I.1144 | Populus trichocarpa | 178 | 179 |
| P.trichocarpa_VIII.1184 | Populus trichocarpa | 180 | 181 |
| P.trichocarpa_X.1083 | Populus trichocarpa | 182 | 183 |
| P.trichocarpa_XIII.387 | Populus trichocarpa | 184 | 185 |
| S.lycopersicum_TA38172 | Solanum lycopersicum | 186 | 187 |
| S.lycopersicum_TA43275 | Lycopersicum | 188 | 189 |
| S.officinarum_TA35800 | Sacharum officinarum | 190 | 191 |
| S.officinarum_TA43377 | Sacharum officinarum | 192 | 193 |
| S.officinarum_TA48272 | Sacharum officinarum | 194 | 195 |
| T.aestivum_CK211981 | Triticum aestivum | 196 | 197 |
| Z.mays_DR791617 | Zea mays | 198 | 199 |
| Z.mays_TA181232 | Zea mays | 200 | 201 |
| Z.mays_TA182909 | Zea mays | 202 | 203 |

1.3. Zinc Finger (Znf) Domain-Containing A20/AN1 Polypeptide

Table A3 provides a list of nucleic acid sequences related to the nucleic acid sequence used in the methods of the present invention.

TABLE A3

Examples of Znf A20/AN1 polypeptide sequences, and encoding nucleic acid sequences:

| Name | Nucleic acid SEQ ID NO: | Polypeptide SEQ ID NO: | Database accession number |
|---|---|---|---|
| AT3G12630.1 | 212 | 213 | AT3G12630.1 |
| Medtr_A20_AN1 | 214 | 215 | NA |
| AT1G12440.1 | 216 | 217 | AT1G12440.1 |
| AT1G51200.1 | 218 | 219 | AT1G51200.1 |
| AT2G27580.1 | 220 | 221 | AT2G27580.1 |
| AT2G36320.1 | 222 | 223 | AT2G36320.1 |
| AT3G52800.1 | 224 | 225 | AT3G52800.1 |
| AT4G12040.1 | 226 | 227 | AT4G12040.1 |
| AT4G14225.1 | 228 | 229 | AT4G14225.1 |
| AT4G22820.1 | 230 | 231 | AT4G22820.1 |
| AT4G25380.1 | 232 | 233 | AT4G25380.1 |
| Lyces_A20_AN1 | 234 | 235 | BI422093 |
| Lyces_A20_AN1_II | 236 | 237 | BT014337 |
| Os01g52030.1 | 238 | 239 | Os01g52030.1 |
| Os01g56040.1 | 240 | 241 | Os01g56040.1 |
| Os02g10200.1 | 242 | 243 | Os02g10200.1 |
| Os02g32840.1 | 244 | 245 | Os02g32840.1 |
| Os03g57890.1 | 246 | 247 | Os03g57890.1 |
| Os03g57900.1 | 248 | 249 | Os03g57900.1 |
| Os06g41010.1 | 250 | 251 | Os06g41010.1 |

TABLE A3-continued

Examples of Znf A20/AN1 polypeptide sequences, and encoding nucleic acid sequences:

| Name | Nucleic acid SEQ ID NO: | Polypeptide SEQ ID NO: | Database accession number |
|---|---|---|---|
| Os07g07350.1 | 252 | 253 | Os07g07350.1 |
| Os08g33880.1 | 254 | 255 | Os08g33880.1 |
| Os08g39450.1 | 256 | 257 | Os08g39450.1 |
| Os09g31200.1 | 258 | 259 | Os09g31200.1 |
| Poptr_A20_AN1 | 260 | 261 | EF146840 |
| Poptr_A20_AN1 II | 262 | 263 | scaff IX.1013 |
| Poptr_A20_AN1 III | 264 | 265 | EF144544.1 |
| Poptr_A20_AN1 IV | 266 | 267 | EF145692.1 |
| Poptr_A20_AN1 V | 268 | 269 | DT510936.1 |
| Triae_A20_AN1 I | 270 | 271 | CK162914 |
| Vitvi_A20_AN1 | 272 | 273 | AM474320 |
| Zeama_AN110 | 274 | 275 | NM_001112792 |
| Zeama_AN13 | 276 | 277 | EF396225.1 |
| Zeama_AN15 | 278 | 279 | NM_001112795.1 |
| Adoae_A20_AN1 I | 280 | 281 | N/A |
| Brana_A20_AN1 I | 282 | 283 | N/A |
| Brana_A20_AN1 II | 284 | 285 | N/A |
| Brana_A20_AN1 III | 286 | 287 | N/A |
| Brana_A20_AN1 IV | 288 | 289 | N/A |
| Brana_A20_AN1 V | 290 | 291 | N/A |
| Brana_A20_AN1 VI | 292 | 293 | N/A |
| Brana_A20_AN1 VII | 294 | 295 | N/A |
| Brana_A20_AN1 VIII | 296 | 297 | N/A |
| Glyma_A20_AN1 I | 298 | 299 | N/A |
| Glyma_A20_AN1 III | 300 | 301 | N/A |
| Glyma_A20_AN1 IV | 302 | 303 | N/A |
| Glyma_A20_AN1 V | 304 | 305 | N/A |
| Glyma_A20_AN1 VI | 306 | 307 | N/A |
| Glyma_A20_AN1 IX | 308 | 309 | N/A |
| Glyma_A20_AN1 X | 310 | 311 | N/A |
| Glyma_A20_AN1 XIV | 312 | 313 | N/A |
| Glyma_A20_AN1 XV | 314 | 315 | N/A |
| Glyma_A20_AN1 XVI | 316 | 317 | N/A |
| Horvu_A20_AN1 | 318 | 319 | N/A |
| Phypa_A20_AN1 III | 320 | 321 | N/A |
| Phypa_A20_AN1 IV | 322 | 323 | N/A |
| Tager_A20_AN1 | 324 | 325 | N/A |
| Triae_A20_AN1 II | 326 | 327 | N/A |
| Zeama_A20_AN1 I | 328 | 329 | N/A |
| Zeama_A20_AN1 II | 330 | 331 | N/A |
| Zeama_A20_AN1 III | 332 | 333 | N/A |
| Zeama_A20_AN1 IV | 334 | 335 | N/A |
| Zeama_A20_AN1 V | 336 | 337 | N/A |

In some instances, related sequences have tentatively been assembled and publicly disclosed by research institutions, such as The Institute for Genomic Research (TIGR). The Eukaryotic Gene Orthologs (EGO) database may be used to identify such related sequences, either by keyword search or by using the BLAST algorithm with the nucleic acid sequence or polypeptide sequence of interest. On other instances, special nucleic acid sequence databases have been created for particular organisms, such as by the Joint Genome Institute, for example for poplar, *Physocmitrella patens*, and *Ostreococcus tauri*.

1.4. PHD-zf Polypeptide

Table A4 provides a list of nucleic acid sequences related to the nucleic acid sequence used in the methods of the present invention.

TABLE A4

Examples of PHD-zf polypeptide sequences, and encoding nucleic acid sequences

| Name | Public database accession number | Nucleic acid SEQ ID NO: | Polypeptide SEQ ID NO: |
|---|---|---|---|
| Lyces_PHD-zf I | NA | 347 | 348 |
| Arath_PHD-zf I | NM_101318.3 | 349 | 350 |
| Arath_PHD-zf II | NM_111955.2 | 351 | 352 |
| Arath_PHD-zf III | NM_114147.4 | 353 | 354 |
| Arath_PHD-zf IV | NM_122058.3 | 355 | 356 |
| Arath_PHD-zf V | NM_180444.2 | 357 | 358 |
| Chlre_PHD-zf | XM_001690305.1 | 359 | 360 |
| Glyma_PHD-zf I | DQ973812.1 | 361 | 362 |
| Glyma_PHD-zf II | DQ973807.1 | 363 | 364 |
| Glyma_PHD-zf III | DQ973808.1 | 365 | 366 |
| Glyma_PHD-zf IV | DQ973809.1 | 367 | 368 |
| Glyma_PHD-zf V | DQ973810.1 | 369 | 370 |
| Glyma_PHD-zf VI | DQ973811.1 | 371 | 372 |
| Horvu_PHD-zf IV | AK251639 | 373 | 374 |
| Lyces_PHD-zf II | BT013089.1 | 375 | 376 |
| Lyces_PHD-zf III | BT013375.1 | 377 | 378 |
| Lyces_PHD-zf IV | TA45452_4081#1 | 379 | 380 |
| Medtr_PHD-zf I | EF025125.1 | 381 | 382 |
| Medtr_PHD-zf III | EF025126.1 | 383 | 384 |
| Medtr_PHD-zf IV | EF025127.1 | 385 | 386 |
| Medtr_PHD-zf V | EF025128.1 | 387 | 388 |
| Medtr_PHD-zf VI | EF025129.1 | 389 | 390 |
| Orysa_PHD-zf I 1 | NM_00105157 | 391 | 392 |
| Orysa_PHD-zf II | NM_001053692 | 393 | 394 |
| Orysa_PHD-zf III | NM_001058242 | 395 | 396 |
| Orysa_PHD-zf IV | NM_001059432 | 397 | 398 |
| Orysa_PHD-zf V | NM_001061268 | 399 | 400 |
| Orysa_PHD-zf VI | NM_001062105 | 401 | 402 |
| Orysa_PHD-zf VII | NM_001065776 | 403 | 404 |
| Orysa_PHD-zf VIII | NM_001066777 | 405 | 406 |
| Orysa_PHD-zf IX | NM_001074131 | 407 | 408 |

TABLE A4-continued

Examples of PHD-zf polypeptide sequences, and encoding nucleic acid sequences

| Name | Public database accession number | Nucleic acid SEQ ID NO: | Polypeptide SEQ ID NO: |
|---|---|---|---|
| Roshy_PHD-zf | EC586603.1 | 409 | 410 |
| Picsi_PHD-zf I | EF085117.1 | 411 | 412 |
| Picsi_PHD-zf II | EF086200.1 | 413 | 414 |
| Picsi_PHD-zf III | EF086724.1 | 415 | 416 |
| Picsi_PHD-zf IV | EF086785.1 | 417 | 418 |
| Picsi_PHD-zf V | EF087755.1 | 419 | 420 |
| Poptr_PHD-zf I | scaff_X.1821 | 421 | 422 |
| Poptr_PHD-zf II | scaff_VI.876 | 423 | 424 |
| Poptr_PHD-zf III | scaff_XVI.1111 | 425 | 426 |
| Poptr_PHD-zf IV | scaff_VIII.629 | 427 | 428 |
| Poptr_PHD-zf V | scaff_VI.1571 | 429 | 430 |
| Poptr_PHD-zf VI | scaff_VI.983 | 431 | 432 |
| Poptr_PHD-zf VII | scaff_III.172 | 433 | 434 |
| Poptr_PHD-zf VIII | scaff_86.90 | 435 | 436 |
| Phypa_PHD-zf I | XM_001759621.1 | 437 | 438 |
| Phypa_PHD-zf II | XM_001760116.1 | 439 | 440 |
| Phypa_PHD-zf III | XM_001762213.1 | 441 | 442 |
| Phypa_PHD-zf IV | XM_001767826.1 | 443 | 444 |
| Phypa_PHD-zf V | XM_001769612.1 | 445 | 446 |
| Phypa_PHD-zf VI | XM_001779597.1 | 447 | 448 |
| Phypa_PHD-zf VII | XM_001783573.1 | 449 | 450 |
| Sacof_PHD-zf II | TA31743_4547#1 | 451 | 452 |
| Sacof_PHD-zf III | TA33655_4547#1 | 453 | 454 |
| Sacof_PHD-zf IV | TA40434_4547#1 | 455 | 456 |
| Sacof_PHD-zf V | TA40459_4547#1 | 457 | 458 |
| Vitvi_PHD-zf I | TA39483_29760#1 | 459 | 460 |
| Vitvi_PHD-zf II | TA36533_29760#1 | 461 | 462 |
| Vitvi_PHD-zf III | TA38877_29760#1 | 463 | 464 |
| Vitvi_PHD-zf IV | TA41896_29760#1 | 465 | 466 |
| Zeama_PHD-zf I | AY104993.1 | 467 | 468 |
| Zeama_PHD-zf II | AY108533.1 | 469 | 470 |
| Zeama_PHD-zf III | BT017810.1 | 471 | 472 |
| Zeama_PHD-zf IV | DQ245239.1 | 473 | 474 |
| Horvu_PHD-zf I | c62655816hv270303@#1 | 475 | 476 |
| Horvu_PHD-zf II | c63057121hv270303@10323#1 | 477 | 478 |
| Horvu_PHD-zf III | c62719521hv270303@7303#1 | 479 | 480 |
| Glyma_PHD-zf VII | GM06MC25145_saa15a04@24582#1 | 481 | 482 |
| Glyma_PHD-zf VIII | GM06MC31284_si15e12@30563#1 | 483 | 484 |
| Tagel_PHD-zf | SIN_31b-CS_SCR16-N6.b1@5419#1 | 485 | 486 |
| Triae_PHD-zf I | c55056972@10436#1 | 487 | 488 |
| Triae_PHD-zf II | c54624646@16120#1 | 489 | 490 |

In some instances, related sequences have tentatively been assembled and publicly disclosed by research institutions, such as The Institute for Genomic Research (TIGR; beginning with TA). The Eukaryotic Gene Orthologs (EGO) database may be used to identify such related sequences, either by keyword search or by using the BLAST algorithm with the nucleic acid sequence or polypeptide sequence of interest. On other instances, special nucleic acid sequence databases have been created for particular organisms, such as by the Joint Genome Institute. Further, access to databases, has allowed the identification of novel nucleic acid and polypeptide sequences.

1.5. REF/ALY Polypeptides

Table A provides a list of nucleic acid sequences related to the nucleic acid sequence used in the methods of the present invention.

TABLE A

Examples of REF/ALY polypeptides:

| Name | Nucleic acid SEQ ID NO: | Protein SEQ ID NO: |
|---|---|---|
| A.thaliana_At5g59950 | 497 | 498 |
| N.tabacum_CAG26902.1 | 499 | 500 |

TABLE A-continued

Examples of REF/ALY polypeptides:

| Name | Nucleic acid SEQ ID NO: | Protein SEQ ID NO: |
|---|---|---|
| N.tabacum_CAJ44457.1 | 501 | 502 |
| A.thaliana_AT5G59950_long | 503 | 504 |
| G.max_GM06MC11519 | 505 | 506 |
| G.max_GM06MC14759 | 507 | 508 |
| H.vulgare_BF262905 | 509 | 510 |
| H.vulgare_TA34369_45131 | 511 | 512 |
| M.truncatula_BG581367 | 513 | 514 |
| M.truncatula_TA20993_38801 | 515 | 516 |
| N.tabacum_CAG26903.1 | 517 | 518 |
| O.sativa_Os03g0278300 | 519 | 520 |
| P.trichocarpa_scaff_226.11 | 521 | 522 |
| P.trichocarpa_scaff_I.1641 | 523 | 524 |
| S.lycopersicum_AW928586 | 525 | 526 |
| S.lycopersicum_TA41256_4081 | 527 | 528 |
| T.aestivum_BT009294 | 529 | 530 |
| T.aestivum_TA72565_4565 | 531 | 532 |
| T.aestivum_TA72566_4565 | 533 | 534 |
| Z.mays_ZM07MC20365 | 535 | 536 |
| Z_mays_AY104617 | 537 | 538 |

Example 2

Alignment of Sequences Related to the Nucleic Acid Sequence Used in the Methods of the Invention 2.1. TFL1-Like Polypeptides Alignment of polypeptide sequences was performed using the AlignX programme from the Vector NTI (Invitrogen) which is based on the popular Clustal W algorithm of progressive alignment (Thompson et al. (1997) Nucleic Acids Res 25:4876-4882; Chenna et al. (2003). Nucleic Acids Res 31:3497-3500). Default values were for the gap open penalty of 10, for the gap extension penalty of 0,1 and the selected weight matrix is Blosum 62 (if polypeptides are aligned). Minor manual editing was done to further optimise the alignment. Sequence conservation among TFL1-like polypeptides is present along the entire protein. A consensus sequence for TFL1-like polypeptides is given. The position of the conserved Histidine and Aspartic amino acid residues respectively located at positions 86 and 142 of SEQ ID NO: 2 is indicated with a box over the residue in the consensus sequence. The TFL1-like polypeptides are aligned in FIG. 1.

A phylogenetic tree of phosphatidylethanolamine-binding proteins (FIG. 2) is reproduced from FIG. 2 of Carmona et al. 2007.

2.2. Ribose 5-Phosphate Isomerase (R5PI)

Alignment of polypeptide sequences was performed using the AlignX programme from the Vector NTI (Invitrogen) which is based on the popular Clustal W algorithm of progressive alignment (Thompson et al. (1997) Nucleic Acids Res 25:4876-4882; Chenna et al. (2003). Nucleic Acids Res 31:3497-3500). Default values are for the gap open penalty of 10, for the gap extension penalty of 0.1 and the selected weight matrix is Blosum 62 (if polypeptides are aligned). The R5PI polypeptides are aligned in FIG. 4. Highly conserved amino acid residues are indicated in the consensus sequence.

A phylogenetic tree of R5PI polypeptides (FIG. 5) was constructed using a neighbour-joining clustering algorithm as provided in the AlignX programme from the Vector NTI (Invitrogen). The A.thaliana_AT1G71100 polypeptide clusters within Group I which comprises cytosolic as well as chloroplastic R5PI polypeptides.

2.3. Zinc Finger (Znf) Domain-Containing A20/AN1 Polypeptide

Multiple sequence alignment of all the Znf A20/AN1 polypeptide sequences in Table A3 was performed using the AlignX algorithm (from Vector NTI 10.3, Invitrogen Corporation). Results of the alignment of Znf A20/AN1 polypeptides from Table A3 are shown in FIG. 9 of the present application. The conserved Cys residues of the A20 zinc finger domain are marked in black, boxed vertically and are also identified at the bottom of the alignment, as are the conserved Cys and His residues of the AN1 zinc finger domain. The A20 zinc finger domain (as represented by SEQ ID NO: 338 (comprised in SEQ ID NO: 213) and by SEQ ID NO: 339 (comprised in SEQ ID NO: 215) is heavily boxed across the aligned polypeptides. The AN1 zinc finger domain (as represented by SEQ ID NO: 340 (comprised in SEQ ID NO: 213) and by SEQ ID NO: 341 (comprised in SEQ ID NO: 215) is also heavily boxed across the aligned polypeptides.

2.4. PHD-zf Polypeptide

Multiple sequence alignment of all the PHD-zf polypeptide sequences in Table A was performed using the AlignX algorithm (from Vector NTI 10.3, Invitrogen Corporation). Results of the alignment are shown in FIG. 13 of the present application. The Conserved Domain (CD) and the PHD-zf IPR001965 are boxed and marked with X's under the consensus sequence line, the predicted TMHMM, the E/D rich motif and KRAR motif are also boxed. The conserved W (Trp) within the PHD-zf is double-underlined.

2.5. REF/ALY Polypeptides

Alignment of polypeptide sequences was performed using the AlignX programme from the Vector NTI (Invitrogen) which is based on the popular Clustal W algorithm of progressive alignment (Thompson et al. (1997) Nucleic Acids Res 25:4876-4882; Chenna et al. (2003). Nucleic Acids Res 31:3497-3500). Default values are for the gap open penalty of 10, for the gap extension penalty of 0,1 and the selected weight matrix is Blosum 62 (if polypeptides are aligned). Minor manual editing was done to further optimise the alignment. Sequence conservation among REF/ALY polypeptides is essentially along the RRM domain and at the N- and C-terminus of the protein flanking the GR rich regions. The REF/ALY polypeptides are aligned in FIG. 16.

A phylogenetic tree of REF/ALY polypeptides (FIG. 16) was constructed using a neighbour-joining clustering algorithm as provided in the AlignX programme from the Vector NTI (Invitrogen).

Example 3

Calculation of Global Percentage Identity Between Polypeptide Sequences Useful in Performing the Methods of the Invention 3.1. TFL1-Like Polypeptides Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:

Scoring matrix: Blosum62

First Gap: 12

Extending gap: 2

Results of the software analysis are shown in Table B1 for the global similarity and identity over the full length of the polypeptide sequences. Percentage identity is given above the diagonal in bold and percentage similarity is given below the diagonal (normal face).

The percentage identity between the TFL1-like polypeptide sequences useful in performing the methods of the invention is as low as 52.3% amino acid identity compared to SEQ ID NO: 2.

TABLE B1

MatGAT results for global similarity and identity over the full length of the polypeptide sequences.

|  | 1 | 2 | 3 | 4 | 5 | 6 | 7 | 8 | 9 | 10 | 11 |
|---|---|---|---|---|---|---|---|---|---|---|---|
| 1. Zeama__TFL1__like__1 |  | 87.0 | 60.7 | 74.3 | 91.9 | 91.9 | 70.1 | 75.1 | 76.4 | 72.0 | 91.9 |
| 2. Zeama__TFL1__like__2 | 89.6 |  | 55.7 | 67.0 | 84.9 | 82.3 | 64.2 | 69.8 | 71.0 | 66.8 | 84.9 |
| 3. Glyma__TFL1__like__1 | 72.8 | 65.6 |  | 59.4 | 62.4 | 63.0 | 71.8 | 59.5 | 59.2 | 55.4 | 60.1 |
| 4. Arath__TFL1__like__1 | 88.6 | 80.7 | 68.6 |  | 74.3 | 75.4 | 68.0 | 80.6 | 77.8 | 73.7 | 74.9 |
| 5. Orysa__TFL1__like__1 | 97.7 | 88.5 | 72.8 | 87.4 |  | 91.9 | 69.5 | 76.9 | 77.6 | 73.7 | 94.2 |
| 6. Orysa__TFL1__like__2 | 96.5 | 87.0 | 72.8 | 88.0 | 97.7 |  | 72.4 | 78.0 | 78.7 | 74.3 | 89.6 |
| 7. Poptr__TFL1-like__1 | 83.9 | 76.6 | 78.2 | 83.4 | 83.9 | 83.9 |  | 70.1 | 69.7 | 66.3 | 69.5 |
| 8. Poptr__TFL1-like__2 | 90.8 | 82.3 | 71.1 | 89.1 | 89.6 | 89.6 | 86.2 |  | 90.8 | 78.9 | 75.1 |
| 9. Poptr__TFL1-like__3 | 90.2 | 82.3 | 71.3 | 90.3 | 89.1 | 89.1 | 85.6 | 97.1 |  | 77.3 | 76.4 |
| 10. Solly__TFL1__like__1 | 86.9 | 80.2 | 70.3 | 88.0 | 87.4 | 87.4 | 81.7 | 92.0 | 91.4 |  | 73.1 |
| 11. Triae__TFL1__like__1 | 97.1 | 88.0 | 71.1 | 88.6 | 97.1 | 96.0 | 83.3 | 89.0 | 88.5 | 88.0 |  |

3.2. Ribose 5-Phosphate Isomerase (R5PI)

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2

Results of the software analysis are shown in Table B2 for the global similarity and identity over the full length of the polypeptide sequences. Percentage identity is given above the diagonal in bold and percentage similarity is given below the diagonal (normal face).

The percentage identity between the R5PI polypeptide sequences given in Table A2 compared to A.thaliana_AT1G71100 polypeptide varies between 38.7 and 71.2%.

3.3. Zinc Finger (Znf) Domain-Containing A20/AN1 Polypeptide

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2

Results of the software analysis are shown in Table B3 for the global similarity and identity over the full length of the polypeptide sequences (excluding the partial polypeptide sequences).

TABLE B2

MatGAT results for global similarity and identity over the full length of the polypeptide sequences.

|  | 1 | 2 | 3 | 4 | 5 | 6 | 7 | 8 | 9 | 10 | 11 | 12 | 13 |
|---|---|---|---|---|---|---|---|---|---|---|---|---|---|
| 1. A.thaliana__AT1G71100 |  | 51.9 | 56.0 | 38.7 | 71.2 | 53.5 | 67.5 | 53.6 | 47.3 | 59.6 | 49.4 | 51.5 | 41.0 |
| 2. A.thaliana__AT3G04790 | 71.4 |  | 58.2 | 52.0 | 56.5 | 69.1 | 57.7 | 44.3 | 44.2 | 62.2 | 58.9 | 67.6 | 33.8 |
| 3. C.reinhardtii__55838 | 72.9 | 71.0 |  | 46.3 | 59.3 | 58.5 | 58.2 | 44.8 | 51.3 | 68.0 | 57.7 | 56.2 | 34.1 |
| 4. G.arboreum__BG444582 | 53.6 | 60.5 | 56.5 |  | 43.3 | 50.5 | 43.2 | 34.6 | 33.8 | 45.7 | 42.5 | 52.9 | 25.9 |
| 5. G.hirsutum__TA22941 | 81.6 | 71.7 | 74.3 | 57.3 |  | 57.3 | 75.6 | 52.9 | 49.1 | 62.7 | 52.6 | 54.8 | 41.7 |
| 6. G.max__TA40887 | 69.0 | 81.9 | 73.0 | 60.1 | 70.8 |  | 56.7 | 46.9 | 43.6 | 65.4 | 59.5 | 77.2 | 35.6 |
| 7. G.max__TA43617 | 82.4 | 71.7 | 74.0 | 56.0 | 86.5 | 72.2 |  | 52.9 | 46.8 | 63.8 | 52.5 | 55.6 | 42.0 |
| 8. O.sativa__Os04g0306400 | 66.9 | 65.9 | 63.3 | 48.7 | 67.6 | 65.1 | 68.7 |  | 41.6 | 44.9 | 39.4 | 42.2 | 61.2 |
| 9. O.tauri__25759 | 61.4 | 61.2 | 66.5 | 50.4 | 63.1 | 59.8 | 61.3 | 57.5 |  | 51.7 | 41.6 | 42.0 | 37.2 |
| 10. P.patens__133835 | 73.0 | 73.9 | 78.8 | 58.9 | 76.9 | 76.2 | 75.2 | 64.4 | 68.0 |  | 73.4 | 63.7 | 38.4 |
| 11. P.patens__221767 | 61.9 | 70.0 | 67.5 | 50.9 | 64.4 | 70.6 | 63.1 | 57.8 | 54.4 | 75.6 |  | 60.2 | 31.2 |
| 12. P.trichocarpa__70.79 | 67.2 | 80.3 | 70.0 | 60.0 | 68.3 | 85.2 | 69.7 | 63.1 | 57.6 | 72.8 | 71.3 |  | 32.2 |
| 13. T.aestivum__CK211981 | 55.4 | 54.7 | 53.5 | 42.0 | 59.2 | 53.0 | 59.4 | 69.1 | 52.9 | 55.3 | 47.2 | 46.6 |  |

TABLE B

| | | | | | | | | | | | | | | | | |
|---|---|---|---|---|---|---|---|---|---|---|---|---|---|---|---|---|
| MatGAT results for global similarity and identity over the full length of the polypeptide sequences. | | | | | | | | | | | | | | | | |
| | 1 | 2 | 3 | 4 | 5 | 6 | 7 | 8 | 9 | 10 | 11 | 12 | 13 | 14 | 15 | 16 |
| 1. Adoae_A20_AN1 | | 49 | 46 | 54 | 55 | 34 | 57 | 46 | 31 | 45 | 34 | 43 | 55 | 54 | 54 | 48 |
| 2. AT1G12440.1 | 61 | | 44 | 43 | 44 | 32 | 42 | 60 | 38 | 61 | 35 | 58 | 43 | 39 | 41 | 40 |
| 3. AT1G51200.1 | 63 | 59 | | 41 | 47 | 38 | 45 | 43 | 32 | 39 | 27 | 42 | 45 | 46 | 39 | 88 |
| 4. AT2G27580.1 | 67 | 63 | 60 | | 50 | 34 | 52 | 45 | 33 | 40 | 33 | 43 | 49 | 49 | 80 | 40 |
| 5. AT2G36320.1 | 64 | 56 | 62 | 64 | | 36 | 70 | 49 | 36 | 42 | 35 | 43 | 72 | 70 | 47 | 42 |
| 6. AT3G12630.1 | 49 | 48 | 56 | 54 | 55 | | 38 | 32 | 30 | 33 | 30 | 31 | 39 | 35 | 33 | 37 |
| 7. AT3G52800.1 | 69 | 57 | 61 | 65 | 82 | 55 | | 44 | 33 | 42 | 35 | 45 | 66 | 74 | 52 | 43 |
| 8. AT4G12040.1 | 63 | 69 | 65 | 61 | 60 | 50 | 57 | | 32 | 66 | 35 | 63 | 43 | 46 | 46 | 42 |
| 9. AT4G14225.1 | 45 | 47 | 47 | 47 | 46 | 47 | 43 | 42 | | 32 | 41 | 33 | 34 | 33 | 34 | 35 |
| 10. AT4G22820.1 | 60 | 71 | 59 | 57 | 55 | 49 | 58 | 75 | 40 | | 34 | 81 | 40 | 38 | 40 | 40 |
| 11. AT4G25380.1 | 45 | 46 | 43 | 48 | 48 | 46 | 47 | 51 | 52 | 49 | | 35 | 34 | 34 | 31 | 27 |
| 12. Brana_A20_AN1\I | 60 | 66 | 59 | 59 | 56 | 46 | 59 | 75 | 39 | 87 | 48 | | 42 | 42 | 41 | 41 |
| 13. Brana_A20_AN1\II | 61 | 53 | 59 | 63 | 82 | 56 | 72 | 55 | 70 | 52 | 50 | 53 | | 70 | 47 | 42 |
| 14. Brana_A20_AN1\III | 65 | 51 | 65 | 65 | 80 | 55 | 84 | 59 | 45 | 51 | 45 | 56 | 78 | | 47 | 44 |
| 15. Brana_A20_AN1\IV | 67 | 62 | 60 | 90 | 66 | 54 | 67 | 65 | 47 | 56 | 46 | 61 | 64 | 66 | | 41 |
| 16. Brana_A20_AN1\V | 66 | 56 | 92 | 58 | 59 | 55 | 60 | 62 | 48 | 56 | 42 | 56 | 59 | 61 | 59 | |
| 17. Brana_A20_AN1\VI | 54 | 51 | 54 | 55 | 53 | 93 | 54 | 52 | 46 | 49 | 46 | 50 | 55 | 56 | 55 | 52 |
| 18. Brana_A20_AN1\VII | 55 | 49 | 54 | 58 | 55 | 94 | 55 | 50 | 45 | 50 | 46 | 48 | 54 | 55 | 55 | 53 |
| 19. Brana_A20_AN1\8 | 53 | 48 | 51 | 56 | 53 | 94 | 52 | 50 | 45 | 49 | 45 | 47 | 55 | 55 | 54 | 51 |
| 20. Glyma_A20_AN1\I | 65 | 59 | 68 | 62 | 57 | 57 | 63 | 61 | 49 | 56 | 43 | 55 | 60 | 59 | 58 | 69 |
| 21. Glyma_A20_AN1\III | 69 | 56 | 63 | 66 | 69 | 54 | 72 | 60 | 47 | 58 | 44 | 58 | 60 | 72 | 65 | 64 |
| 22. Glyma_A20_AN1\IV | 72 | 59 | 62 | 66 | 73 | 54 | 69 | 64 | 48 | 60 | 48 | 59 | 68 | 69 | 66 | 62 |
| 23. Glyma_A20_AN1\IX | 65 | 57 | 72 | 58 | 59 | 57 | 61 | 61 | 49 | 56 | 45 | 55 | 59 | 61 | 57 | 74 |
| 24. Glyma_A20_AN1\V | 67 | 62 | 58 | 71 | 62 | 56 | 64 | 57 | 49 | 57 | 51 | 59 | 64 | 63 | 64 | 56 |
| 25. Glyma_A20_AN1\VI | 71 | 58 | 61 | 64 | 66 | 51 | 71 | 59 | 42 | 59 | 44 | 58 | 59 | 70 | 63 | 61 |
| 26. Glyma_A20_AN1\X | 66 | 61 | 69 | 61 | 57 | 57 | 65 | 59 | 48 | 57 | 44 | 54 | 59 | 62 | 60 | 69 |
| 27. Glyma_A20_AN1\14 | 73 | 59 | 62 | 65 | 71 | 53 | 72 | 61 | 46 | 58 | 47 | 57 | 66 | 71 | 65 | 62 |
| 28. Glyma_A20_AN1\15 | 58 | 49 | 56 | 56 | 55 | 72 | 59 | 51 | 44 | 51 | 45 | 49 | 53 | 56 | 58 | 56 |
| 29. Glyma_A20_AN1\16 | 57 | 51 | 56 | 55 | 58 | 74 | 58 | 51 | 44 | 50 | 45 | 51 | 55 | 57 | 59 | 55 |
| 30. Horvu_A20_AN1 | 57 | 57 | 56 | 62 | 57 | 61 | 59 | 55 | 44 | 51 | 42 | 52 | 58 | 64 | 61 | 55 |
| 31. Os01g52030.1 | 53 | 54 | 54 | 52 | 50 | 50 | 49 | 54 | 49 | 54 | 53 | 53 | 51 | 49 | 53 | 53 |
| 32. Os01g56040.1 | 61 | 59 | 58 | 56 | 55 | 51 | 54 | 57 | 50 | 53 | 49 | 53 | 57 | 58 | 57 | 57 |
| 33. Os02g10200.1 | 61 | 57 | 70 | 60 | 58 | 56 | 64 | 59 | 49 | 52 | 45 | 54 | 58 | 60 | 57 | 68 |
| 34. Os02g32840.1 | 66 | 57 | 56 | 60 | 62 | 53 | 59 | 56 | 50 | 52 | 49 | 54 | 64 | 60 | 57 | 57 |
| 35. Os03g57890.1 | 57 | 58 | 57 | 63 | 59 | 58 | 59 | 54 | 49 | 52 | 47 | 52 | 55 | 58 | 62 | 54 |
| 36. Os03g57900.1 | 57 | 57 | 58 | 55 | 53 | 53 | 59 | 55 | 44 | 53 | 46 | 56 | 57 | 54 | 54 | 59 |
| 37. Os06g41010.1 | 62 | 60 | 70 | 61 | 64 | 57 | 64 | 59 | 50 | 52 | 46 | 57 | 60 | 64 | 59 | 68 |
| 38. Os07g07350.1 | 58 | 60 | 59 | 64 | 60 | 60 | 59 | 57 | 47 | 55 | 50 | 58 | 60 | 56 | 63 | 57 |
| 39. Os08g33880.1 | 49 | 43 | 46 | 44 | 43 | 38 | 45 | 46 | 36 | 44 | 36 | 44 | 42 | 44 | 45 | 45 |
| 40. Os08g39450.1 | 61 | 53 | 57 | 55 | 55 | 64 | 58 | 54 | 41 | 53 | 42 | 54 | 57 | 58 | 52 | 57 |
| 41. Lyces_A20_AN1 | 53 | 48 | 53 | 53 | 51 | 68 | 54 | 50 | 42 | 48 | 43 | 51 | 48 | 52 | 53 | 55 |
| 42. Lyces_A20_AN1\II | 66 | 60 | 68 | 61 | 62 | 60 | 67 | 65 | 53 | 60 | 49 | 58 | 63 | 62 | 64 | 68 |
| 43. Medtr_A20_AN1 | 50 | 50 | 50 | 53 | 51 | 66 | 55 | 49 | 44 | 49 | 45 | 49 | 51 | 56 | 52 | 50 |
| 44. Phypa_A20_AN1\III | 60 | 56 | 57 | 57 | 55 | 50 | 57 | 56 | 38 | 58 | 43 | 59 | 52 | 57 | 55 | 57 |
| 45. Phypa_A20_AN1\IV | 60 | 52 | 56 | 55 | 56 | 49 | 57 | 55 | 43 | 55 | 44 | 59 | 53 | 53 | 53 | 62 |
| 46. Poptr_A20_AN1 | 55 | 48 | 54 | 54 | 51 | 69 | 55 | 49 | 39 | 49 | 42 | 50 | 52 | 54 | 51 | 54 |
| 47. Poptr_A20_AN1\II | 54 | 49 | 54 | 53 | 50 | 71 | 56 | 48 | 37 | 48 | 43 | 54 | 53 | 53 | 54 | 57 |
| 48. Poptr_A20_AN1\III | 66 | 56 | 78 | 62 | 61 | 58 | 65 | 63 | 49 | 57 | 47 | 57 | 61 | 65 | 62 | 75 |
| 49. Poptr_A20_AN1\IV | 65 | 61 | 76 | 64 | 60 | 60 | 65 | 63 | 51 | 56 | 48 | 58 | 59 | 66 | 62 | 75 |
| 50. Poptr_A20_AN1\V | 63 | 72 | 63 | 61 | 55 | 50 | 60 | 74 | 45 | 73 | 46 | 70 | 55 | 56 | 60 | 61 |
| 51. Tager_A20_AN1 | 58 | 64 | 55 | 61 | 53 | 51 | 53 | 62 | 42 | 61 | 45 | 62 | 52 | 56 | 61 | 56 |
| 52. Triae_A20_AN1\I | 58 | 54 | 53 | 56 | 53 | 61 | 59 | 53 | 40 | 51 | 42 | 53 | 54 | 57 | 54 | 55 |
| 53. Triae_A20_AN1\II | 58 | 51 | 57 | 61 | 58 | 63 | 61 | 53 | 42 | 55 | 41 | 54 | 58 | 62 | 58 | 57 |
| 54. Vitvi_A20_AN1 | 56 | 54 | 50 | 57 | 55 | 72 | 58 | 55 | 44 | 52 | 44 | 50 | 52 | 54 | 56 | 53 |
| 55. Zeama_A20_AN1\I | 65 | 58 | 58 | 58 | 61 | 49 | 61 | 55 | 51 | 54 | 45 | 54 | 65 | 63 | 61 | 61 |
| 56. Zeama_A20_AN1\II | 59 | 57 | 58 | 60 | 55 | 66 | 57 | 51 | 43 | 55 | 42 | 53 | 54 | 58 | 56 | 61 |
| 57. Zeama_A20_AN1\III | 65 | 59 | 69 | 57 | 60 | 53 | 62 | 58 | 50 | 54 | 44 | 56 | 58 | 60 | 57 | 68 |
| 58. Zeama_A20_AN1\IV | 54 | 49 | 50 | 55 | 53 | 58 | 53 | 48 | 38 | 49 | 43 | 48 | 51 | 56 | 60 | 51 |
| 59. Zeama_A20_AN1\V | 63 | 58 | 69 | 62 | 60 | 54 | 63 | 57 | 47 | 52 | 43 | 58 | 58 | 58 | 57 | 66 |
| 60. Zeama_AN110 | 54 | 49 | 53 | 54 | 52 | 60 | 52 | 49 | 37 | 48 | 46 | 49 | 50 | 53 | 62 | 53 |
| 61. Zeama_AN13 | 61 | 58 | 70 | 58 | 62 | 54 | 60 | 61 | 49 | 54 | 43 | 54 | 58 | 57 | 58 | 70 |
| 62. Zeama_AN15 | 58 | 56 | 56 | 61 | 55 | 63 | 61 | 52 | 43 | 52 | 43 | 51 | 57 | 60 | 60 | 55 |

| | 17 | 18 | 19 | 20 | 21 | 22 | 23 | 24 | 25 | 26 | 27 | 28 | 29 | 30 | 31 |
|---|---|---|---|---|---|---|---|---|---|---|---|---|---|---|---|
| 1. Adoae_A20_AN1 | 35 | 36 | 35 | 46 | 57 | 59 | 49 | 61 | 54 | 46 | 60 | 41 | 41 | 41 | 39 |
| 2. AT1G12440.1 | 32 | 32 | 32 | 41 | 45 | 48 | 38 | 45 | 43 | 40 | 46 | 34 | 35 | 33 | 40 |
| 3. AT1G51200.1 | 37 | 35 | 35 | 55 | 45 | 46 | 64 | 43 | 44 | 56 | 46 | 39 | 40 | 37 | 40 |
| 4. AT2G27580.1 | 34 | 35 | 35 | 44 | 48 | 48 | 39 | 58 | 48 | 42 | 45 | 36 | 36 | 42 | 39 |
| 5. AT2G36320.1 | 36 | 36 | 36 | 42 | 57 | 57 | 46 | 51 | 54 | 41 | 57 | 37 | 38 | 42 | 36 |
| 6. AT3G12630.1 | 88 | 88 | 87 | 37 | 36 | 35 | 36 | 37 | 37 | 38 | 35 | 60 | 61 | 49 | 35 |
| 7. AT3G52800.1 | 34 | 37 | 36 | 43 | 56 | 56 | 44 | 54 | 55 | 43 | 55 | 38 | 38 | 41 | 34 |
| 8. AT4G12040.1 | 33 | 32 | 33 | 41 | 46 | 46 | 39 | 41 | 43 | 38 | 44 | 34 | 35 | 38 | 38 |
| 9. AT4G14225.1 | 32 | 31 | 31 | 37 | 31 | 36 | 36 | 33 | 32 | 36 | 35 | 28 | 28 | 33 | 35 |
| 10. AT4G22820.1 | 33 | 33 | 33 | 38 | 44 | 44 | 36 | 42 | 45 | 39 | 44 | 36 | 36 | 38 | 39 |
| 11. AT4G25380.1 | 30 | 30 | 31 | 28 | 33 | 34 | 28 | 35 | 32 | 29 | 35 | 32 | 33 | 29 | 35 |

TABLE B-continued

MatGAT results for global similarity and identity over the full length of the polypeptide sequences.

| | | | | | | | | | | | | | | |
|---|---|---|---|---|---|---|---|---|---|---|---|---|---|---|
| 12. Brana_A20_AN1\I | 30 | 31 | 30 | 38 | 46 | 44 | 38 | 42 | 44 | 40 | 44 | 35 | 36 | 37 | 38 |
| 13. Brana_A20_AN1\II | 37 | 38 | 38 | 41 | 49 | 54 | 45 | 53 | 48 | 40 | 52 | 41 | 43 | 43 | 36 |
| 14. Brana_A20_AN1\III | 35 | 36 | 36 | 44 | 56 | 54 | 45 | 51 | 54 | 44 | 56 | 37 | 39 | 45 | 36 |
| 15. Brana_A20_AN1\IV | 36 | 34 | 34 | 40 | 46 | 47 | 37 | 51 | 46 | 40 | 44 | 35 | 35 | 39 | 38 |
| 16. Brana_A20_AN1\V | 36 | 34 | 34 | 56 | 48 | 48 | 64 | 41 | 45 | 56 | 45 | 37 | 39 | 39 | 39 |
| 17. Brana_A20_AN1\VI | | 87 | 87 | 36 | 35 | 35 | 37 | 36 | 35 | 36 | 36 | 59 | 62 | 46 | 35 |
| 18. Brana_A20_AN1\VII | 92 | | 98 | 36 | 37 | 36 | 38 | 38 | 35 | 34 | 36 | 61 | 63 | 50 | 35 |
| 19. Brana_A20_AN1\8 | 92 | 99 | | 36 | 36 | 36 | 38 | 37 | 33 | 34 | 35 | 61 | 63 | 50 | 35 |
| 20. Glyma_A20_AN1\I | 54 | 54 | 54 | | 45 | 47 | 67 | 45 | 43 | 92 | 46 | 37 | 38 | 37 | 40 |
| 21. Glyma_A20_AN1\III | 51 | 54 | 54 | 65 | | 66 | 43 | 51 | 86 | 47 | 66 | 40 | 41 | 43 | 38 |
| 22. Glyma_A20_AN1\IV | 51 | 55 | 53 | 64 | 75 | | 49 | 58 | 67 | 49 | 92 | 42 | 42 | 40 | 37 |
| 23. Glyma_A20_AN1\IX | 54 | 55 | 54 | 77 | 59 | 62 | | 43 | 42 | 65 | 47 | 36 | 37 | 39 | 39 |
| 24. Glyma_A20_AN1\V | 56 | 56 | 55 | 63 | 64 | 74 | 57 | | 50 | 46 | 57 | 39 | 38 | 37 | 38 |
| 25. Glyma_A20_AN1\VI | 49 | 48 | 49 | 64 | 89 | 73 | 61 | 64 | | 45 | 67 | 39 | 39 | 39 | 36 |
| 26. Glyma_A20_AN1\X | 54 | 55 | 54 | 94 | 67 | 65 | 77 | 62 | 66 | | 47 | 37 | 38 | 38 | 37 |
| 27. Glyma_A20_AN1\14 | 50 | 52 | 50 | 62 | 73 | 95 | 62 | 72 | 75 | 62 | | 40 | 42 | 39 | 39 |
| 28. Glyma_A20_AN1\15 | 69 | 73 | 71 | 58 | 55 | 59 | 53 | 53 | 52 | 54 | 57 | | 96 | 54 | 38 |
| 29. Glyma_A20_AN1\16 | 71 | 75 | 73 | 56 | 54 | 59 | 54 | 53 | 51 | 55 | 59 | 97 | | 52 | 38 |
| 30. Horvu_A20_AN1 | 60 | 64 | 63 | 55 | 60 | 62 | 52 | 56 | 58 | 57 | 57 | 68 | 68 | | 42 |
| 31. Os01g52030.1 | 53 | 55 | 53 | 52 | 49 | 55 | 54 | 55 | 48 | 52 | 55 | 50 | 53 | 53 | |
| 32. Os01g56040.1 | 50 | 52 | 51 | 56 | 56 | 65 | 56 | 60 | 57 | 58 | 66 | 53 | 53 | 58 | 57 |
| 33. Os02g10200.1 | 52 | 57 | 56 | 78 | 59 | 60 | 82 | 59 | 61 | 77 | 62 | 57 | 57 | 55 | 51 |
| 34. Os02g32840.1 | 52 | 53 | 51 | 56 | 65 | 72 | 54 | 67 | 65 | 57 | 69 | 59 | 57 | 59 | 58 |
| 35. Os03g57890.1 | 58 | 59 | 58 | 57 | 58 | 60 | 58 | 60 | 56 | 57 | 60 | 58 | 58 | 57 | 53 |
| 36. Os03g57900.1 | 50 | 53 | 50 | 57 | 61 | 56 | 58 | 50 | 59 | 57 | 59 | 52 | 53 | 54 | 50 |
| 37. Os06g41010.1 | 56 | 58 | 57 | 80 | 65 | 61 | 83 | 60 | 61 | 79 | 61 | 54 | 60 | 56 | 54 |
| 38. Os07g07350.1 | 57 | 62 | 59 | 55 | 55 | 58 | 55 | 62 | 54 | 57 | 59 | 60 | 62 | 56 | 55 |
| 39. Os08g33880.1 | 38 | 41 | 39 | 42 | 50 | 49 | 46 | 44 | 48 | 41 | 45 | 41 | 39 | 43 | 40 |
| 40. Os08g39450.1 | 62 | 63 | 62 | 55 | 59 | 52 | 57 | 52 | 57 | 55 | 54 | 65 | 70 | 78 | 50 |
| 41. Lyces_A20_AN1 | 65 | 67 | 65 | 51 | 51 | 50 | 51 | 48 | 53 | 51 | 51 | 70 | 69 | 61 | 47 |
| 42. Lyces_A20_AN1\II | 61 | 64 | 62 | 80 | 63 | 67 | 73 | 63 | 62 | 79 | 67 | 59 | 61 | 59 | 57 |
| 43. Medtr_A20_AN1 | 67 | 66 | 66 | 54 | 53 | 51 | 54 | 52 | 51 | 54 | 55 | 71 | 71 | 59 | 48 |
| 44. Phypa_A20_AN1\III | 49 | 51 | 50 | 57 | 57 | 56 | 57 | 52 | 57 | 57 | 55 | 56 | 53 | 54 | 50 |
| 45. Phypa_A20_AN1\IV | 47 | 53 | 47 | 56 | 60 | 57 | 60 | 53 | 59 | 57 | 57 | 54 | 53 | 52 | 51 |
| 46. Poptr_A20_AN1 | 64 | 68 | 66 | 54 | 56 | 53 | 55 | 49 | 58 | 56 | 53 | 71 | 71 | 66 | 46 |
| 47. Poptr_A20_AN1\II | 65 | 69 | 68 | 53 | 54 | 51 | 52 | 51 | 55 | 53 | 51 | 73 | 72 | 65 | 50 |
| 48. Poptr_A20_AN1\III | 57 | 59 | 58 | 79 | 63 | 66 | 83 | 62 | 62 | 80 | 67 | 56 | 56 | 56 | 54 |
| 49. Poptr_A20_AN1\IV | 55 | 59 | 58 | 81 | 64 | 65 | 84 | 63 | 67 | 81 | 65 | 58 | 58 | 57 | 56 |
| 50. Poptr_A20_AN1\V | 50 | 49 | 48 | 60 | 62 | 59 | 59 | 58 | 58 | 61 | 59 | 52 | 52 | 52 | 55 |
| 51. Tager_A20_AN1 | 49 | 50 | 48 | 59 | 59 | 55 | 59 | 60 | 59 | 58 | 57 | 52 | 52 | 51 | 57 |
| 52. Triae_A20_AN1\I | 60 | 64 | 63 | 52 | 61 | 55 | 55 | 54 | 58 | 54 | 56 | 66 | 66 | 78 | 50 |
| 53. Triae_A20_AN1\II | 61 | 65 | 64 | 55 | 58 | 61 | 54 | 57 | 57 | 57 | 60 | 68 | 70 | 93 | 54 |
| 54. Vitvi_A20_AN1 | 69 | 73 | 71 | 61 | 59 | 56 | 55 | 52 | 58 | 61 | 55 | 73 | 73 | 65 | 52 |
| 55. Zeama_A20_AN1\I | 53 | 54 | 52 | 56 | 60 | 69 | 57 | 66 | 61 | 57 | 70 | 57 | 57 | 56 | 61 |
| 56. Zeama_A20_AN1\II | 61 | 67 | 66 | 58 | 58 | 58 | 50 | 58 | 57 | 60 | 59 | 71 | 71 | 77 | 55 |
| 57. Zeama_A20_AN1\III | 49 | 56 | 55 | 78 | 63 | 63 | 81 | 58 | 64 | 77 | 63 | 56 | 58 | 57 | 53 |
| 58. Zeama_A20_AN1\IV | 58 | 59 | 57 | 54 | 53 | 57 | 48 | 52 | 54 | 56 | 53 | 65 | 65 | 69 | 51 |
| 59. Zeama_A20_AN1\V | 52 | 58 | 57 | 77 | 62 | 63 | 81 | 56 | 61 | 77 | 63 | 57 | 60 | 56 | 52 |
| 60. Zeama_AN110 | 60 | 60 | 58 | 52 | 55 | 53 | 49 | 53 | 52 | 56 | 51 | 66 | 65 | 68 | 50 |
| 61. Zeama_AN13 | 52 | 55 | 54 | 75 | 63 | 62 | 82 | 57 | 61 | 75 | 62 | 55 | 54 | 58 | 52 |
| 62. Zeama_AN15 | 61 | 65 | 62 | 55 | 60 | 58 | 53 | 58 | 58 | 58 | 58 | 68 | 70 | 76 | 58 |

| | 32 | 33 | 34 | 35 | 36 | 37 | 38 | 39 | 40 | 41 | 42 | 43 | 44 | 45 | 46 |
|---|---|---|---|---|---|---|---|---|---|---|---|---|---|---|---|
| 1. Adoae_A20_AN1 | 40 | 45 | 53 | 43 | 38 | 44 | 44 | 37 | 40 | 40 | 48 | 35 | 42 | 44 | 41 |
| 2. AT1G12440.1 | 39 | 38 | 46 | 45 | 40 | 38 | 42 | 32 | 34 | 32 | 40 | 33 | 39 | 38 | 32 |
| 3. AT1G51200.1 | 37 | 55 | 42 | 41 | 39 | 56 | 42 | 32 | 35 | 35 | 52 | 31 | 41 | 40 | 38 |
| 4. AT2G27580.1 | 39 | 40 | 50 | 40 | 39 | 40 | 44 | 33 | 39 | 36 | 40 | 30 | 40 | 40 | 36 |
| 5. AT2G36320.1 | 39 | 43 | 47 | 45 | 40 | 46 | 46 | 33 | 41 | 36 | 45 | 33 | 41 | 42 | 35 |
| 6. AT3G12630.1 | 31 | 36 | 37 | 41 | 34 | 40 | 45 | 27 | 49 | 57 | 41 | 57 | 34 | 36 | 59 |
| 7. AT3G52800.1 | 36 | 44 | 47 | 43 | 39 | 44 | 42 | 30 | 38 | 38 | 46 | 36 | 39 | 42 | 37 |
| 8. AT4G12040.1 | 38 | 39 | 43 | 43 | 40 | 38 | 43 | 32 | 35 | 31 | 40 | 30 | 40 | 42 | 30 |
| 9. AT4G14225.1 | 35 | 33 | 38 | 35 | 32 | 35 | 37 | 24 | 30 | 27 | 39 | 27 | 28 | 30 | 27 |
| 10. AT4G22820.1 | 39 | 33 | 40 | 40 | 40 | 34 | 41 | 32 | 36 | 29 | 40 | 32 | 40 | 39 | 32 |
| 11. AT4G25380.1 | 33 | 27 | 36 | 36 | 33 | 25 | 35 | 25 | 31 | 29 | 31 | 32 | 27 | 30 | 29 |
| 12. Brana_A20_AN1\I | 40 | 35 | 44 | 40 | 40 | 39 | 44 | 33 | 37 | 33 | 37 | 31 | 37 | 40 | 29 |
| 13. Brana_A20_AN1\II | 40 | 40 | 52 | 44 | 40 | 44 | 48 | 30 | 41 | 35 | 44 | 37 | 40 | 43 | 37 |
| 14. Brana_A20_AN1\III | 41 | 43 | 49 | 45 | 40 | 45 | 44 | 31 | 41 | 36 | 46 | 34 | 41 | 42 | 39 |
| 15. Brana_A20_AN1\IV | 38 | 39 | 45 | 41 | 35 | 38 | 43 | 33 | 35 | 36 | 41 | 32 | 37 | 37 | 35 |
| 16. Brana_A20_AN1\V | 39 | 55 | 43 | 40 | 44 | 54 | 40 | 30 | 35 | 36 | 55 | 31 | 43 | 40 | 34 |
| 17. Brana_A20_AN1\VI | 31 | 37 | 37 | 42 | 34 | 41 | 41 | 26 | 46 | 55 | 38 | 55 | 34 | 35 | 55 |
| 18. Brana_A20_AN1\III | 31 | 38 | 35 | 41 | 37 | 38 | 43 | 29 | 46 | 55 | 41 | 53 | 33 | 35 | 56 |
| 19. Brana_A20_AN1\8 | 31 | 38 | 36 | 40 | 35 | 38 | 42 | 29 | 44 | 54 | 40 | 52 | 33 | 35 | 56 |
| 20. Glyma_A20_AN1\I | 36 | 63 | 41 | 43 | 37 | 65 | 40 | 27 | 38 | 34 | 67 | 31 | 40 | 40 | 39 |
| 21. Glyma_A20_AN1\III | 42 | 44 | 51 | 42 | 41 | 44 | 40 | 37 | 43 | 36 | 45 | 35 | 42 | 42 | 41 |
| 22. Glyma_A20_AN1\IV | 48 | 45 | 57 | 47 | 42 | 45 | 43 | 38 | 38 | 35 | 50 | 34 | 43 | 43 | 39 |
| 23. Glyma_A20_AN1\IX | 37 | 67 | 40 | 41 | 37 | 70 | 43 | 32 | 40 | 35 | 61 | 34 | 39 | 39 | 37 |
| 24. Glyma_A20_AN1\V | 46 | 46 | 55 | 45 | 40 | 45 | 45 | 32 | 37 | 36 | 46 | 33 | 38 | 39 | 37 |

TABLE B-continued

MatGAT results for global similarity and identity over the full length of the polypeptide sequences.

| | | | | | | | | | | | | | | |
|---|---|---|---|---|---|---|---|---|---|---|---|---|---|---|
| 25. Glyma_A20_AN1\VI | 41 | 44 | 51 | 41 | 40 | 43 | 40 | 34 | 39 | 39 | 43 | 34 | 39 | 43 | 42 |
| 26. Glyma_A20_AN1\X | 38 | 60 | 40 | 43 | 40 | 65 | 39 | 29 | 38 | 36 | 66 | 35 | 39 | 39 | 38 |
| 27. Glyma_A20_AN1\14 | 47 | 45 | 56 | 44 | 41 | 45 | 45 | 35 | 38 | 36 | 48 | 37 | 42 | 43 | 38 |
| 28. Glyma_A20_AN1\15 | 35 | 37 | 43 | 44 | 36 | 39 | 45 | 28 | 50 | 62 | 40 | 62 | 39 | 42 | 60 |
| 29. Glyma_A20_AN1\16 | 35 | 38 | 40 | 44 | 39 | 42 | 45 | 28 | 53 | 63 | 44 | 62 | 39 | 42 | 60 |
| 30. Horvu_A20_AN1 | 37 | 39 | 42 | 41 | 37 | 40 | 43 | 27 | 65 | 48 | 41 | 45 | 38 | 40 | 50 |
| 31. Os01g52030.1 | 38 | 37 | 45 | 38 | 36 | 40 | 40 | 29 | 39 | 34 | 43 | 34 | 39 | 39 | 33 |
| 32. Os01g56040.1 | | 40 | 55 | 37 | 38 | 39 | 42 | 35 | 35 | 33 | 37 | 34 | 36 | 37 | 32 |
| 33. Os02g10200.1 | 60 | | 40 | 40 | 38 | 85 | 41 | 33 | 41 | 35 | 64 | 34 | 42 | 43 | 39 |
| 34. Os02g32840.1 | 65 | 56 | | 45 | 41 | 39 | 45 | 38 | 37 | 34 | 40 | 34 | 40 | 42 | 35 |
| 35. Os03g57890.1 | 55 | 59 | 58 | | 46 | 41 | 70 | 34 | 38 | 43 | 43 | 39 | 42 | 43 | 39 |
| 36. Os03g57900.1 | 55 | 57 | 56 | 56 | | 38 | 44 | 39 | 38 | 34 | 39 | 29 | 41 | 41 | 32 |
| 37. Os06g41010.1 | 59 | 90 | 57 | 60 | 56 | | 44 | 31 | 42 | 37 | 65 | 36 | 44 | 44 | 39 |
| 38. Os07g07350.1 | 57 | 58 | 58 | 78 | 59 | 60 | | 36 | 41 | 42 | 43 | 40 | 41 | 42 | 39 |
| 39. Os08g33880.1 | 46 | 47 | 45 | 45 | 50 | 45 | 48 | | 29 | 31 | 30 | 27 | 36 | 37 | 28 |
| 40. Os08g39450.1 | 55 | 57 | 56 | 53 | 59 | 57 | 54 | 44 | | 49 | 42 | 43 | 41 | 36 | 51 |
| 41. Lyces_A20_AN1 | 51 | 52 | 48 | 54 | 50 | 52 | 54 | 45 | 67 | | 38 | 54 | 36 | 36 | 65 |
| 42. Lyces_A20_AN1\II | 59 | 76 | 59 | 62 | 58 | 77 | 63 | 44 | 56 | 52 | | 37 | 42 | 44 | 40 |
| 43. Medtr_A20_AN1 | 54 | 52 | 50 | 55 | 52 | 52 | 58 | 42 | 61 | 62 | 57 | | 33 | 34 | 51 |
| 44. Phypa_A20_AN1\III | 52 | 56 | 53 | 55 | 56 | 58 | 56 | 50 | 57 | 53 | 59 | 49 | | 75 | 37 |
| 45. Phypa_A20_AN1\IV | 53 | 59 | 54 | 55 | 55 | 62 | 56 | 51 | 53 | 54 | 57 | 51 | 84 | | 35 |
| 46. Poptr_A20_AN1 | 53 | 54 | 51 | 52 | 53 | 55 | 53 | 42 | 68 | 74 | 56 | 64 | 52 | 50 | |
| 47. Poptr_A20_AN1\II | 52 | 54 | 52 | 53 | 54 | 53 | 55 | 44 | 70 | 76 | 56 | 64 | 54 | 51 | 88 |
| 48. Poptr_A20_AN1\III | 59 | 76 | 59 | 59 | 56 | 80 | 58 | 45 | 56 | 52 | 79 | 52 | 60 | 62 | 56 |
| 49. Poptr_A20_AN1\IV | 61 | 78 | 59 | 61 | 61 | 80 | 61 | 43 | 56 | 53 | 80 | 54 | 61 | 63 | 59 |
| 50. Poptr_A20_AN1\V | 52 | 60 | 56 | 56 | 58 | 59 | 57 | 46 | 54 | 50 | 62 | 45 | 57 | 56 | 49 |
| 51. Tager_A20_AN1 | 54 | 61 | 54 | 54 | 51 | 59 | 57 | 46 | 53 | 48 | 61 | 51 | 51 | 53 | 50 |
| 52. Triae_A20_AN1\I | 54 | 51 | 56 | 54 | 52 | 55 | 51 | 43 | 87 | 59 | 55 | 57 | 53 | 55 | 63 |
| 53. Triae_A20_AN1\II | 58 | 56 | 57 | 53 | 53 | 57 | 54 | 43 | 74 | 62 | 61 | 56 | 57 | 56 | 66 |
| 54. Vitvi_A20_AN1 | 57 | 57 | 56 | 53 | 58 | 56 | 58 | 42 | 69 | 71 | 59 | 69 | 55 | 55 | 69 |
| 55. Zeama_A20_AN1\I | 65 | 58 | 73 | 55 | 54 | 57 | 57 | 42 | 55 | 48 | 59 | 50 | 55 | 52 | 51 |
| 56. Zeama_A20_AN1\II | 59 | 52 | 60 | 56 | 55 | 56 | 58 | 46 | 76 | 61 | 58 | 61 | 56 | 53 | 62 |
| 57. Zeama_A20_AN1\III | 57 | 88 | 59 | 60 | 60 | 87 | 59 | 47 | 57 | 53 | 74 | 54 | 57 | 59 | 54 |
| 58. Zeama_A20_AN1\IV | 52 | 51 | 53 | 53 | 52 | 49 | 53 | 44 | 77 | 62 | 56 | 55 | 57 | 57 | 65 |
| 59. Zeama_A20_AN1\V | 56 | 90 | 57 | 59 | 57 | 88 | 59 | 48 | 55 | 55 | 74 | 53 | 57 | 59 | 58 |
| 60. Zeama_AN110 | 52 | 52 | 53 | 53 | 53 | 51 | 53 | 42 | 76 | 61 | 53 | 55 | 55 | 56 | 63 |
| 61. Zeama_AN13 | 58 | 88 | 57 | 56 | 55 | 90 | 57 | 46 | 58 | 55 | 72 | 50 | 60 | 59 | 55 |
| 62. Zeama_AN15 | 56 | 54 | 60 | 57 | 57 | 56 | 58 | 42 | 76 | 58 | 59 | 57 | 56 | 53 | 61 |

| | 47 | 48 | 49 | 50 | 51 | 52 | 53 | 54 | 55 | 56 | 57 | 58 | 59 | 60 | 61 |
|---|---|---|---|---|---|---|---|---|---|---|---|---|---|---|---|
| 1. Adoae_A20_AN1 | 38 | 46 | 46 | 45 | 43 | 40 | 42 | 37 | 52 | 41 | 44 | 42 | 45 | 39 | 44 |
| 2. AT1G12440.1 | 32 | 40 | 42 | 59 | 57 | 36 | 36 | 37 | 44 | 37 | 39 | 36 | 38 | 35 | 36 |
| 3. AT1G51200.1 | 37 | 65 | 63 | 42 | 38 | 37 | 39 | 38 | 43 | 42 | 57 | 39 | 56 | 38 | 54 |
| 4. AT2G27580.1 | 34 | 39 | 40 | 44 | 42 | 39 | 40 | 39 | 48 | 39 | 38 | 38 | 39 | 38 | 39 |
| 5. AT2G36320.1 | 37 | 48 | 47 | 41 | 37 | 40 | 44 | 38 | 48 | 39 | 43 | 39 | 43 | 38 | 43 |
| 6. AT3G12630.1 | 61 | 38 | 38 | 34 | 34 | 50 | 48 | 59 | 37 | 50 | 38 | 45 | 37 | 47 | 39 |
| 7. AT3G52800.1 | 39 | 48 | 45 | 41 | 36 | 39 | 44 | 39 | 45 | 38 | 42 | 40 | 45 | 37 | 44 |
| 8. AT4G12040.1 | 31 | 41 | 40 | 58 | 50 | 36 | 37 | 36 | 40 | 36 | 37 | 33 | 35 | 33 | 39 |
| 9. AT4G14225.1 | 27 | 38 | 40 | 36 | 31 | 31 | 32 | 31 | 38 | 33 | 35 | 28 | 32 | 28 | 35 |
| 10. AT4G22820.1 | 29 | 37 | 36 | 56 | 48 | 35 | 39 | 34 | 41 | 35 | 36 | 35 | 32 | 35 | 35 |
| 11. AT4G25380.1 | 29 | 31 | 31 | 32 | 35 | 31 | 30 | 31 | 32 | 29 | 26 | 30 | 28 | 32 | 25 |
| 12. Brana_A20_AN1\I | 31 | 40 | 38 | 55 | 50 | 37 | 39 | 35 | 41 | 35 | 35 | 35 | 37 | 35 | 35 |
| 13. Brana_A20_AN1\II | 37 | 46 | 44 | 40 | 39 | 40 | 42 | 40 | 52 | 40 | 42 | 36 | 42 | 37 | 44 |
| 14. Brana_A20_AN1\III | 39 | 48 | 48 | 40 | 41 | 44 | 45 | 38 | 50 | 42 | 43 | 40 | 41 | 39 | 42 |
| 15. Brana_A20_AN1\IV | 35 | 39 | 39 | 41 | 43 | 35 | 37 | 37 | 46 | 37 | 37 | 39 | 37 | 40 | 39 |
| 16. Brana_A20_AN1\V | 39 | 62 | 62 | 40 | 37 | 39 | 40 | 39 | 42 | 43 | 58 | 37 | 55 | 38 | 52 |
| 17. Brana_A20_AN1\VI | 57 | 37 | 38 | 35 | 35 | 47 | 47 | 58 | 36 | 48 | 35 | 44 | 36 | 46 | 38 |
| 18. Brana_A20_AN1\III | 55 | 38 | 37 | 32 | 33 | 50 | 50 | 59 | 36 | 48 | 37 | 45 | 37 | 46 | 39 |
| 19. Brana_A20_AN1\8 | 57 | 37 | 36 | 32 | 34 | 49 | 49 | 57 | 36 | 47 | 37 | 44 | 37 | 45 | 39 |
| 20. Glyma_A20_AN1\I | 37 | 66 | 68 | 41 | 39 | 33 | 36 | 39 | 42 | 40 | 64 | 38 | 62 | 36 | 61 |
| 21. Glyma_A20_AN1\III | 39 | 45 | 43 | 46 | 42 | 42 | 40 | 40 | 47 | 41 | 45 | 41 | 43 | 38 | 44 |
| 22. Glyma_A20_AN1\IV | 37 | 50 | 46 | 45 | 41 | 38 | 41 | 39 | 56 | 41 | 47 | 39 | 46 | 39 | 45 |
| 23. Glyma_A20_AN1\IX | 37 | 76 | 75 | 40 | 40 | 37 | 41 | 37 | 46 | 40 | 66 | 38 | 66 | 37 | 68 |
| 24. Glyma_A20_AN1\V | 37 | 47 | 47 | 40 | 42 | 38 | 39 | 36 | 53 | 37 | 44 | 36 | 42 | 36 | 44 |
| 25. Glyma_A20_AN1\VI | 37 | 44 | 44 | 42 | 42 | 40 | 42 | 41 | 47 | 40 | 45 | 38 | 42 | 39 | 41 |
| 26. Glyma_A20_AN1\X | 37 | 68 | 69 | 44 | 40 | 35 | 36 | 37 | 41 | 39 | 64 | 39 | 63 | 38 | 61 |
| 27. Glyma_A20_AN1\14 | 37 | 49 | 47 | 45 | 42 | 38 | 41 | 39 | 55 | 39 | 45 | 40 | 43 | 37 | 45 |
| 28. Glyma_A20_AN1\15 | 59 | 38 | 40 | 34 | 35 | 52 | 52 | 62 | 41 | 53 | 39 | 48 | 38 | 49 | 39 |
| 29. Glyma_A20_AN1\16 | 62 | 39 | 41 | 36 | 35 | 51 | 54 | 63 | 41 | 54 | 40 | 49 | 41 | 49 | 39 |
| 30. Horvu_A20_AN1 | 49 | 40 | 38 | 35 | 34 | 67 | 90 | 49 | 43 | 69 | 38 | 63 | 37 | 62 | 39 |
| 31. Os01g52030.1 | 35 | 38 | 41 | 39 | 38 | 39 | 41 | 34 | 50 | 44 | 40 | 42 | 39 | 40 | 40 |
| 32. Os01g56040.1 | 31 | 39 | 39 | 42 | 38 | 35 | 37 | 35 | 52 | 37 | 40 | 33 | 38 | 34 | 38 |
| 33. Os02g10200.1 | 38 | 66 | 65 | 42 | 41 | 36 | 39 | 41 | 43 | 38 | 83 | 35 | 83 | 36 | 81 |
| 34. Os02g32840.1 | 36 | 39 | 42 | 42 | 44 | 38 | 42 | 38 | 66 | 44 | 41 | 39 | 39 | 39 | 39 |
| 35. Os03g57890.1 | 36 | 44 | 44 | 40 | 41 | 39 | 38 | 42 | 40 | 38 | 43 | 38 | 40 | 39 | 41 |
| 36. Os03g57900.1 | 34 | 39 | 39 | 38 | 36 | 36 | 36 | 39 | 41 | 35 | 41 | 35 | 39 | 36 | 39 |
| 37. Os06g41010.1 | 40 | 71 | 70 | 41 | 38 | 36 | 41 | 42 | 42 | 41 | 83 | 38 | 81 | 38 | 82 |

TABLE B-continued

MatGAT results for global similarity and identity over the full length of the polypeptide sequences.

| | | | | | | | | | | | | | | |
|---|---|---|---|---|---|---|---|---|---|---|---|---|---|---|
| 38. Os07g07350.1 | 40 | 44 | 44 | 43 | 43 | 41 | 41 | 43 | 43 | 41 | 44 | 40 | 42 | 39 | 41 |
| 39. Os08g33880.1 | 29 | 32 | 31 | 34 | 34 | 30 | 28 | 30 | 33 | 30 | 33 | 31 | 32 | 30 | 30 |
| 40. Os08g39450.1 | 53 | 41 | 39 | 37 | 35 | 75 | 62 | 49 | 42 | 63 | 39 | 65 | 40 | 65 | 43 |
| 41. Lyces__A20__AN1 | 65 | 36 | 37 | 34 | 31 | 48 | 49 | 61 | 35 | 48 | 36 | 46 | 38 | 47 | 37 |
| 42. Lyces__A20__AN1\II | 40 | 64 | 62 | 44 | 42 | 41 | 40 | 43 | 43 | 42 | 63 | 39 | 60 | 37 | 62 |
| 43. Medtr__A20__AN1 | 53 | 34 | 34 | 27 | 34 | 44 | 44 | 52 | 32 | 44 | 34 | 42 | 35 | 41 | 33 |
| 44. Phypa__A20__AN1\III | 36 | 41 | 43 | 39 | 36 | 36 | 40 | 38 | 40 | 40 | 42 | 38 | 41 | 38 | 46 |
| 45. Phypa__A20__AN1\IV | 35 | 43 | 44 | 40 | 37 | 38 | 41 | 38 | 37 | 40 | 44 | 39 | 43 | 40 | 42 |
| 46. Poptr__A20__AN1 | 85 | 39 | 40 | 28 | 33 | 50 | 48 | 56 | 35 | 48 | 39 | 47 | 38 | 47 | 39 |
| 47. Poptr__A20__AN1\II | | 37 | 37 | 32 | 36 | 48 | 51 | 61 | 34 | 49 | 38 | 48 | 37 | 46 | 37 |
| 48. Poptr__A20__AN1\III | 55 | | 91 | 42 | 39 | 38 | 40 | 40 | 43 | 40 | 69 | 39 | 68 | 40 | 69 |
| 49. Poptr__A20__AN1\IV | 57 | 94 | | 40 | 38 | 36 | 40 | 39 | 45 | 39 | 69 | 38 | 68 | 38 | 67 |
| 50. Poptr__A20__AN1\V | 51 | 63 | 63 | | 53 | 37 | 36 | 36 | 41 | 38 | 42 | 34 | 40 | 34 | 39 |
| 51. Tager__A20__AN1 | 54 | 55 | 57 | 68 | | 35 | 33 | 39 | 43 | 33 | 40 | 40 | 37 | 38 | 38 |
| 52. Triae__A20__AN1\I | 63 | 54 | 54 | 52 | 53 | | 67 | 49 | 44 | 67 | 38 | 65 | 39 | 65 | 39 |
| 53. Triae__A20__AN1\II | 65 | 55 | 58 | 53 | 50 | 77 | | 48 | 43 | 71 | 39 | 67 | 39 | 66 | 40 |
| 54. Vitvi__A20__AN1 | 74 | 58 | 59 | 55 | 54 | 63 | 65 | | 38 | 51 | 40 | 49 | 39 | 48 | 41 |
| 55. Zeama__A20__AN1\I | 52 | 61 | 58 | 53 | 57 | 60 | 55 | 54 | | 45 | 44 | 44 | 44 | 44 | 44 |
| 56. Zeama__A20__AN1\II | 63 | 58 | 59 | 53 | 52 | 77 | 80 | 65 | 58 | | 38 | 60 | 39 | 60 | 41 |
| 57. Zeama__A20__AN1\III | 53 | 78 | 79 | 61 | 62 | 54 | 56 | 57 | 59 | 53 | | 38 | 91 | 37 | 77 |
| 58. Zeama__A20__AN1\IV | 65 | 54 | 53 | 48 | 58 | 76 | 73 | 63 | 54 | 71 | 52 | | 39 | 95 | 38 |
| 59. Zeama__A20__AN1\V | 55 | 78 | 79 | 60 | 57 | 54 | 56 | 58 | 60 | 54 | 95 | 52 | | 38 | 78 |
| 60. Zeama__AN110 | 63 | 56 | 54 | 47 | 55 | 74 | 71 | 62 | 55 | 70 | 51 | 97 | 51 | | 38 |
| 61. Zeama__AN13 | 53 | 80 | 80 | 61 | 58 | 54 | 56 | 59 | 57 | 56 | 84 | 51 | 86 | 54 | |
| 62. Zeama__AN15 | 63 | 57 | 57 | 54 | 50 | 77 | 79 | 66 | 57 | 86 | 55 | 70 | 56 | 70 | 55 |

The percentage identity between the full length polypeptide sequences useful in performing the methods of the invention can be as low as 25% amino acid identity compared to SEQ ID NO: 213 or to SEQ ID NO: 215.

The percentage identity can be substantially increased if the identity calculation is performed between the A20 zinc finger domain of SEQ ID NO: 213 (as represented by SEQ ID NO: 338) or of SEQ ID NO: 215 (as represented by SEQ ID NO: 339), and the A20 zinc finger domain of the Znf A20/AN1 polypeptides of Table A3 represented in FIG. 9. Similarly, the percentage identity can also be substantially increased if the identity calculation is performed between the AN1 zinc finger domain of SEQ ID NO: 213 (as represented by SEQ ID NO: 340) or of SEQ ID NO: 215 (as represented by SEQ ID NO: 341), and the AN1 zinc finger domain of the Znf A20/AN1 polypeptides of Table A3 represented in FIG. 9.

3.4. PHD-zf Polypeptide

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2

Results of the software analysis are shown in Table B4 for the global similarity and identity over the full length of the polypeptide sequences (excluding the partial polypeptide sequences).

The percentage identity between the full length polypeptide sequences useful in performing the methods of the invention can be as low as 49% amino acid identity compared to SEQ ID NO: 348.

TABLE B4

MatGAT results for global similarity and identity over the full length of the polypeptide sequences of Table A.

| | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 |
|---|---|---|---|---|---|---|---|---|---|---|---|---|---|---|---|---|---|---|---|---|---|---|---|---|---|
| **1. Lyces__PHD-zf*\I** | | 56 | 70 | 61 | 58 | 68 | 46 | 61 | 60 | 61 | 60 | 59 | 60 | 69 | 55 | 55 | 56 | 54 | 60 | 61 | 71 | 60 | 58 | 71 | 54 |
| 2. Arath__PHD-zf\I | 73 | | 62 | 69 | 66 | 65 | 47 | 69 | 68 | 69 | 68 | 81 | 71 | 62 | 64 | 63 | 54 | 61 | 64 | 77 | 62 | 69 | 68 | 60 | 76 |
| 3. Arath__PHD-zf\II | 85 | 74 | | 62 | 60 | 87 | 51 | 63 | 63 | 62 | 63 | 65 | 63 | 76 | 56 | 58 | 60 | 57 | 62 | 65 | 79 | 62 | 59 | 76 | 61 |
| 4. Arath__PHD-zf\III | 80 | 82 | 79 | | 74 | 62 | 42 | 74 | 73 | 72 | 76 | 71 | 74 | 64 | 61 | 63 | 56 | 65 | 71 | 70 | 65 | 72 | 70 | 62 | 63 |
| 5. Arath__PHD-zf\IV | 77 | 80 | 77 | 86 | | 59 | 45 | 74 | 76 | 70 | 76 | 70 | 77 | 59 | 62 | 62 | 55 | 65 | 69 | 70 | 61 | 71 | 68 | 61 | 63 |
| 6. Arath__PHD-zf\V | 82 | 74 | 91 | 77 | 75 | | 52 | 63 | 62 | 63 | 63 | 65 | 63 | 76 | 58 | 59 | 58 | 59 | 60 | 64 | 79 | 62 | 60 | 77 | 60 |
| 7. Chlre__PHD-zf | 65 | 63 | 66 | 60 | 63 | 65 | | 46 | 44 | 48 | 46 | 48 | 46 | 50 | 46 | 46 | 47 | 44 | 44 | 48 | 51 | 44 | 44 | 50 | 45 |
| 8. Glyma__PHD-zf\I | 82 | 83 | 81 | 88 | 89 | 79 | 62 | | 82 | 85 | 83 | 73 | 83 | 62 | 66 | 68 | 54 | 70 | 77 | 72 | 64 | 90 | 82 | 62 | 68 |
| 9. Glyma__PHD-zf\II | 78 | 85 | 79 | 86 | 89 | 77 | 61 | 92 | | 76 | 84 | 73 | 88 | 61 | 66 | 67 | 56 | 68 | 76 | 71 | 62 | 80 | 72 | 62 | 66 |
| 10. Glyma__PHD-zf\III | 80 | 80 | 81 | 86 | 83 | 78 | 63 | 93 | 86 | | 79 | 71 | 78 | 64 | 63 | 64 | 55 | 66 | 75 | 71 | 64 | 81 | 82 | 64 | 68 |
| 11. Glyma__PHD-zf\IV | 79 | 81 | 79 | 89 | 89 | 75 | 60 | 92 | 93 | 87 | | 72 | 81 | 63 | 63 | 67 | 58 | 68 | 76 | 72 | 62 | 81 | 73 | 63 | 67 |
| 12. Glyma__PHD-zf\V | 75 | 90 | 77 | 81 | 84 | 75 | 63 | 85 | 85 | 81 | 82 | | 75 | 65 | 63 | 68 | 55 | 65 | 67 | 83 | 64 | 73 | 70 | 64 | 84 |
| 13. Glyma__PHD-zf\VI | 79 | 83 | 77 | 86 | 89 | 77 | 63 | 90 | 93 | 87 | 89 | 83 | | 63 | 67 | 68 | 59 | 68 | 78 | 74 | 64 | 81 | 72 | 63 | 69 |
| 14. Glyma__PHD-zf\VII | 83 | 72 | 86 | 78 | 74 | 85 | 64 | 78 | 76 | 79 | 76 | 75 | 77 | | 56 | 56 | 63 | 56 | 63 | 65 | 84 | 61 | 61 | 90 | 60 |

TABLE B4-continued

MatGAT results for global similarity and identity over the full length of the polypeptide sequences of Table A.

| | | | | | | | | | | | | | | | | | | | | | | | | | |
|---|---|---|---|---|---|---|---|---|---|---|---|---|---|---|---|---|---|---|---|---|---|---|---|---|---|
| 15. Horvu_PHD-zf\I | 70 | 77 | 72 | 75 | 77 | 70 | 59 | 76 | 76 | 75 | 77 | 76 | 77 | 71 | | 79 | 56 | 63 | 66 | 64 | 57 | 64 | 63 | 57 | 61 |
| 16. Horvu_PHD-zf\II | 72 | 76 | 74 | 76 | 77 | 72 | 59 | 78 | 78 | 74 | 78 | 78 | 77 | 72 | 89 | | 55 | 58 | 65 | 67 | 58 | 67 | 64 | 58 | 62 |
| 17. Horvu_PHD-zf\III | 76 | 70 | 76 | 74 | 73 | 75 | 60 | 74 | 73 | 72 | 77 | 71 | 75 | 78 | 73 | 71 | | 54 | 60 | 58 | 62 | 55 | 54 | 61 | 52 |
| 18. Horvu_PHD-zf\IV | 72 | 75 | 71 | 79 | 81 | 70 | 58 | 83 | 80 | 78 | 79 | 75 | 79 | 70 | 76 | 75 | 69 | | 64 | 66 | 58 | 69 | 63 | 56 | 64 |
| 19. Lyces_PHD-zf\II | 75 | 79 | 77 | 85 | 85 | 73 | 60 | 88 | 86 | 84 | 88 | 80 | 87 | 75 | 76 | 78 | 76 | 78 | | 71 | 64 | 77 | 73 | 62 | 63 |
| 20. Lyces_PHD-zf\III | 78 | 87 | 78 | 82 | 82 | 74 | 62 | 83 | 85 | 82 | 82 | 92 | 84 | 74 | 75 | 78 | 76 | 74 | 81 | | 64 | 73 | 70 | 65 | 78 |
| 21. Lyces_PHD-zf\IV | 86 | 75 | 90 | 80 | 76 | 91 | 65 | 80 | 78 | 81 | 77 | 77 | 79 | 93 | 72 | 73 | 74 | 72 | 76 | 79 | | 63 | 61 | 84 | 59 |
| 22. Medtr_PHD-zf\I | 80 | 82 | 80 | 86 | 88 | 78 | 59 | 97 | 90 | 91 | 90 | 84 | 89 | 77 | 78 | 78 | 74 | 81 | 87 | 83 | 79 | | 78 | 62 | 66 |
| 23. Medtr_PHD-zf\III | 78 | 82 | 78 | 86 | 82 | 75 | 61 | 90 | 85 | 88 | 85 | 84 | 82 | 76 | 76 | 77 | 72 | 76 | 85 | 82 | 76 | 89 | | 61 | 64 |
| 24. Medtr_PHD-zf\IV | 84 | 73 | 86 | 78 | 74 | 86 | 66 | 79 | 77 | 80 | 77 | 75 | 78 | 96 | 72 | 72 | 79 | 71 | 75 | 75 | 93 | 79 | 77 | | 60 |
| 25. Medtr_PHD-zf\V | 69 | 84 | 73 | 76 | 78 | 71 | 59 | 78 | 78 | 76 | 77 | 89 | 78 | 70 | 76 | 76 | 67 | 74 | 76 | 84 | 71 | 78 | 76 | 70 | |
| 26. Medtr_PHD-zf\VI | 74 | 83 | 75 | 81 | 84 | 73 | 61 | 87 | 89 | 83 | 88 | 83 | 88 | 76 | 75 | 76 | 74 | 76 | 82 | 81 | 73 | 86 | 81 | 77 | 75 |
| 27. Orysa_PHD-zf\I | 71 | 74 | 70 | 76 | 77 | 68 | 57 | 76 | 77 | 73 | 77 | 74 | 73 | 69 | 89 | 88 | 70 | 73 | 77 | 73 | 70 | 76 | 74 | 70 | 73 |
| 28. Orysa_PHD-zf\II | 70 | 75 | 70 | 75 | 78 | 67 | 57 | 76 | 76 | 73 | 77 | 73 | 75 | 66 | 79 | 79 | 69 | 74 | 76 | 75 | 70 | 76 | 71 | 67 | 75 |
| 29. Orysa_PHD-zf\III | 79 | 71 | 81 | 76 | 70 | 79 | 59 | 74 | 74 | 74 | 75 | 71 | 74 | 82 | 73 | 72 | 77 | 69 | 73 | 74 | 83 | 75 | 74 | 83 | 68 |
| 30. Orysa_PHD-zf\IV | 76 | 73 | 77 | 76 | 76 | 74 | 59 | 74 | 75 | 71 | 77 | 72 | 77 | 80 | 70 | 72 | 92 | 69 | 78 | 74 | 78 | 77 | 73 | 81 | 67 |
| 31. Orysa_PHD-zf\IX | 74 | 83 | 76 | 80 | 80 | 74 | 61 | 82 | 83 | 80 | 82 | 81 | 83 | 72 | 85 | 83 | 73 | 74 | 81 | 83 | 74 | 83 | 81 | 73 | 76 |
| 32. Orysa_PHD-zf\VI | 73 | 80 | 72 | 79 | 79 | 73 | 60 | 80 | 80 | 74 | 78 | 79 | 79 | 71 | 89 | 91 | 71 | 74 | 80 | 80 | 73 | 80 | 77 | 71 | 75 |
| 33. Orysa_PHD-zf\VII | 77 | 72 | 82 | 75 | 74 | 81 | 60 | 76 | 75 | 76 | 76 | 73 | 75 | 83 | 70 | 70 | 72 | 68 | 72 | 74 | 84 | 76 | 74 | 83 | 69 |
| 34. Orysa_PHD-zf\VIII | 69 | 75 | 71 | 79 | 80 | 68 | 56 | 81 | 78 | 76 | 79 | 76 | 78 | 70 | 74 | 72 | 69 | 89 | 77 | 76 | 72 | 81 | 76 | 69 | 75 |
| 35. Oyrsa_PHD-zf\IV | 67 | 75 | 72 | 74 | 77 | 71 | 64 | 76 | 74 | 73 | 78 | 73 | 75 | 69 | 75 | 74 | 69 | 71 | 76 | 74 | 68 | 74 | 72 | 68 | 70 |
| 36. Phypa_PHD-zf\I | 81 | 79 | 82 | 84 | 83 | 80 | 64 | 87 | 86 | 83 | 84 | 82 | 84 | 79 | 75 | 74 | 75 | 76 | 79 | 78 | 82 | 85 | 84 | 80 | 75 |
| 37. Phypa_PHD-zf\II | 79 | 78 | 81 | 83 | 81 | 79 | 65 | 84 | 85 | 82 | 84 | 81 | 82 | 78 | 76 | 75 | 76 | 74 | 78 | 80 | 82 | 83 | 81 | 80 | 75 |
| 38. Phypa_PHD-zf\III | 79 | 78 | 81 | 82 | 81 | 79 | 62 | 84 | 85 | 80 | 84 | 81 | 81 | 78 | 76 | 76 | 77 | 76 | 77 | 79 | 81 | 82 | 81 | 79 | 75 |
| 39. Phypa_PHD-zf\IV | 82 | 79 | 82 | 85 | 84 | 79 | 65 | 87 | 85 | 84 | 84 | 84 | 84 | 80 | 77 | 75 | 76 | 76 | 80 | 81 | 82 | 84 | 82 | 82 | 75 |
| 40. Phypa_PHD-zf\V | 78 | 77 | 82 | 81 | 79 | 81 | 65 | 81 | 83 | 80 | 82 | 79 | 80 | 82 | 74 | 74 | 75 | 75 | 78 | 78 | 86 | 81 | 81 | 82 | 73 |
| 41. Phypa_PHD-zf\VI | 80 | 78 | 81 | 84 | 83 | 78 | 62 | 88 | 86 | 84 | 84 | 82 | 79 | 73 | 75 | 76 | 78 | 79 | 80 | 81 | 85 | 82 | 80 | 76 | |
| 42. Phypa_PHD-zf\VII | 82 | 77 | 83 | 82 | 81 | 82 | 66 | 85 | 83 | 83 | 83 | 81 | 84 | 80 | 73 | 73 | 75 | 77 | 76 | 80 | 82 | 83 | 82 | 82 | 75 |
| 43. Picsi_PHD-zf\I | 76 | 81 | 80 | 82 | 83 | 76 | 61 | 86 | 87 | 84 | 87 | 82 | 85 | 76 | 77 | 77 | 76 | 76 | 83 | 82 | 78 | 86 | 83 | 77 | 77 |
| 44. Picsi_PHD-zf\II | 80 | 84 | 80 | 87 | 86 | 78 | 63 | 89 | 88 | 85 | 89 | 85 | 87 | 79 | 78 | 75 | 76 | 80 | 84 | 84 | 81 | 89 | 84 | 80 | 78 |
| 45. Picsi_PHD-zf\III | 79 | 77 | 81 | 79 | 75 | 79 | 62 | 80 | 79 | 80 | 78 | 80 | 82 | 75 | 73 | 76 | 72 | 76 | 78 | 83 | 80 | 76 | 82 | 73 | |
| 46. Picsi_PHD-zf\IV | 74 | 85 | 78 | 84 | 86 | 77 | 61 | 87 | 87 | 82 | 86 | 83 | 86 | 74 | 80 | 81 | 77 | 79 | 85 | 84 | 78 | 86 | 82 | 75 | 80 |
| 47. Picsi_PHD-zf\V | 75 | 86 | 77 | 85 | 84 | 76 | 62 | 88 | 87 | 84 | 84 | 84 | 86 | 75 | 77 | 78 | 74 | 79 | 83 | 82 | 77 | 87 | 84 | 76 | 78 |
| 48. Poptr_PHD-zf\I | 83 | 72 | 86 | 78 | 74 | 85 | 66 | 78 | 74 | 77 | 77 | 74 | 77 | 89 | 69 | 70 | 77 | 68 | 76 | 74 | 89 | 76 | 75 | 88 | 69 |
| 49. Poptr_PHD-zf\II | 84 | 72 | 86 | 78 | 74 | 86 | 63 | 79 | 76 | 77 | 77 | 74 | 77 | 95 | 71 | 73 | 77 | 69 | 72 | 76 | 92 | 77 | 73 | 94 | 71 |
| 50. Poptr_PHD-zf\III | 85 | 71 | 85 | 77 | 73 | 86 | 63 | 78 | 75 | 76 | 76 | 74 | 76 | 94 | 72 | 72 | 77 | 69 | 73 | 75 | 92 | 77 | 75 | 94 | 68 |
| 51. Poptr_PHD-zf\IV | 83 | 73 | 87 | 79 | 75 | 86 | 64 | 78 | 73 | 77 | 77 | 74 | 76 | 89 | 70 | 69 | 78 | 68 | 75 | 74 | 90 | 76 | 74 | 87 | 69 |
| 52. Poptr_PHD-zf\V | 80 | 82 | 81 | 90 | 90 | 78 | 63 | 94 | 96 | 89 | 95 | 84 | 92 | 78 | 78 | 79 | 76 | 82 | 88 | 85 | 79 | 92 | 86 | 79 | 80 |
| 53. Poptr_PHD-zf\VI | 78 | 82 | 75 | 86 | 87 | 75 | 60 | 89 | 91 | 86 | 90 | 83 | 89 | 77 | 77 | 78 | 74 | 81 | 86 | 83 | 78 | 90 | 84 | 79 | 77 |
| 54. Poptr_PHD-zf\VII | 73 | 91 | 76 | 81 | 80 | 74 | 64 | 85 | 82 | 83 | 93 | 82 | 73 | 76 | 77 | 72 | 78 | 82 | 91 | 74 | 84 | 83 | 73 | 85 | |
| 55. Poptr_PHD-zf\VIII | 74 | 90 | 75 | 81 | 81 | 74 | 64 | 84 | 81 | 81 | 82 | 93 | 81 | 73 | 76 | 78 | 71 | 76 | 81 | 91 | 73 | 83 | 83 | 72 | 85 |
| 56. Roshy_PHD-zf\ | 83 | 74 | 87 | 80 | 75 | 88 | 67 | 78 | 79 | 79 | 77 | 77 | 79 | 91 | 71 | 72 | 78 | 71 | 75 | 75 | 92 | 78 | 77 | 91 | 71 |
| 57. Sacof_PHD-zf\II | 74 | 80 | 74 | 78 | 79 | 73 | 59 | 78 | 80 | 77 | 80 | 78 | 79 | 71 | 81 | 80 | 71 | 74 | 78 | 79 | 74 | 80 | 78 | 72 | 75 |
| 58. Sacof_PHD-zf\III | 73 | 80 | 73 | 81 | 78 | 70 | 62 | 79 | 80 | 74 | 81 | 79 | 78 | 73 | 88 | 91 | 74 | 72 | 79 | 77 | 73 | 79 | 77 | 73 | 76 |
| 59. Sacof_PHD-zf\IV | 80 | 72 | 80 | 76 | 73 | 78 | 64 | 73 | 75 | 73 | 73 | 71 | 76 | 78 | 70 | 71 | 82 | 68 | 72 | 73 | 81 | 75 | 71 | 81 | 65 |
| 60. Sacof_PHD-zf\V | 77 | 75 | 78 | 75 | 75 | 77 | 61 | 78 | 75 | 74 | 79 | 73 | 75 | 78 | 70 | 71 | 74 | 68 | 72 | 71 | 78 | 75 | 74 | 78 | 70 |
| 61. Tager_PHD-zf | 80 | 71 | 83 | 76 | 71 | 83 | 62 | 74 | 74 | 73 | 72 | 72 | 74 | 85 | 68 | 68 | 71 | 69 | 69 | 73 | 87 | 75 | 70 | 83 | 69 |
| 62. Triae_PHD-zf\I | 71 | 75 | 71 | 80 | 81 | 69 | 57 | 82 | 80 | 77 | 79 | 75 | 79 | 70 | 75 | 72 | 71 | 97 | 78 | 74 | 73 | 82 | 76 | 72 | 74 |
| 63. Triae_PHD-zf\II | 74 | 83 | 74 | 80 | 79 | 71 | 61 | 82 | 81 | 79 | 80 | 81 | 82 | 72 | 81 | 81 | 72 | 73 | 79 | 82 | 74 | 81 | 80 | 73 | 76 |
| 64. Vitvi_PHD-zf\I | 84 | 73 | 87 | 79 | 77 | 87 | 65 | 80 | 80 | 80 | 78 | 76 | 79 | 92 | 73 | 75 | 76 | 68 | 74 | 76 | 93 | 79 | 76 | 93 | 71 |
| 65. Vitvi_PHD-zf\II | 77 | 83 | 79 | 89 | 90 | 77 | 62 | 93 | 94 | 87 | 93 | 85 | 91 | 77 | 78 | 78 | 74 | 80 | 87 | 84 | 79 | 91 | 87 | 79 | 79 |
| 66. Vitvi_PHD-zf\III | 85 | 70 | 85 | 78 | 75 | 86 | 65 | 78 | 77 | 76 | 74 | 77 | 90 | 69 | 69 | 78 | 69 | 74 | 74 | 90 | 77 | 76 | 89 | 69 | |
| 67. Vitvi_PHD-zf\IV | 73 | 90 | 75 | 81 | 80 | 73 | 62 | 83 | 81 | 78 | 85 | 91 | 81 | 72 | 77 | 77 | 74 | 76 | 80 | 89 | 74 | 82 | 82 | 72 | 85 |
| 68. Zeama_PHD-zf\I | 73 | 81 | 73 | 80 | 81 | 70 | 61 | 78 | 81 | 77 | 80 | 79 | 78 | 71 | 79 | 79 | 74 | 73 | 79 | 80 | 73 | 78 | 74 | 73 | 75 |
| 69. Zeama_PHD-zf\II | 73 | 79 | 73 | 81 | 79 | 70 | 59 | 79 | 79 | 75 | 80 | 78 | 77 | 73 | 88 | 89 | 73 | 71 | 77 | 78 | 73 | 79 | 75 | 73 | 75 |
| 70. Zeama_PHD-zf\III | 64 | 61 | 68 | 61 | 65 | 67 | 52 | 64 | 64 | 64 | 66 | 61 | 62 | 68 | 60 | 64 | 67 | 63 | 63 | 64 | 70 | 66 | 63 | 70 | 62 |
| 71. Zeama_PHD-zf\IV | 81 | 73 | 81 | 75 | 74 | 78 | 64 | 42 | 75 | 74 | 74 | 72 | 77 | 80 | 71 | 41 | 83 | 69 | 74 | 74 | 42 | 76 | 72 | 82 | 39 |

| | 26 | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 |
|---|---|---|---|---|---|---|---|---|---|---|---|---|---|---|---|---|---|---|---|---|---|---|---|---|---|
| **1. Lyces_PHD-zf\*\I | 57 | 54 | 54 | 61 | 58 | 57 | 57 | 62 | 55 | 50 | 62 | 61 | 60 | 62 | 60 | 61 | 62 | 54 | 62 | 59 | 58 | 59 | 69 | 71 | 71** |
| 2. Arath_PHD-zf\I | 69 | 63 | 62 | 55 | 55 | 70 | 67 | 60 | 63 | 60 | 63 | 62 | 62 | 65 | 58 | 63 | 63 | 67 | 71 | 60 | 73 | 72 | 59 | 61 | 60 |
| 3. Arath_PHD-zf\II | 61 | 57 | 57 | 65 | 60 | 61 | 57 | 70 | 58 | 52 | 65 | 65 | 64 | 66 | 65 | 64 | 66 | 61 | 65 | 67 | 65 | 62 | 78 | 78 | 77 |
| 4. Arath_PHD-zf\III | 68 | 64 | 62 | 57 | 58 | 67 | 65 | 60 | 65 | 58 | 66 | 66 | 65 | 69 | 65 | 69 | 69 | 68 | 72 | 61 | 73 | 73 | 62 | 62 | 61 |
| 5. Arath_PHD-zf\IV | 69 | 62 | 62 | 53 | 56 | 68 | 64 | 56 | 63 | 60 | 64 | 63 | 66 | 60 | 65 | 64 | 68 | 71 | 58 | 72 | 70 | 56 | 60 | 58 | |
| 6. Arath_PHD-zf\V | 60 | 57 | 54 | 63 | 59 | 59 | 60 | 69 | 57 | 54 | 65 | 63 | 64 | 66 | 64 | 65 | 66 | 59 | 64 | 67 | 64 | 63 | 76 | 79 | 78 |
| 7. Chlre_PHD-zf | 46 | 42 | 42 | 45 | 45 | 48 | 45 | 47 | 42 | 47 | 47 | 47 | 46 | 48 | 48 | 45 | 47 | 45 | 45 | 47 | 45 | 44 | 49 | 49 | 49 |
| 8. Glyma_PHD-zf\I | 75 | 67 | 64 | 56 | 55 | 71 | 71 | 58 | 70 | 63 | 73 | 70 | 69 | 75 | 67 | 74 | 74 | 75 | 78 | 64 | 78 | 78 | 61 | 64 | 62 |
| 9. Glyma_PHD-zf\II | 77 | 66 | 62 | 57 | 57 | 72 | 69 | 60 | 68 | 61 | 69 | 68 | 68 | 72 | 66 | 71 | 70 | 75 | 76 | 63 | 77 | 77 | 59 | 62 | 61 |
| 10. Glyma_PHD-zf\III | 72 | 64 | 64 | 53 | 56 | 72 | 66 | 58 | 66 | 61 | 69 | 70 | 68 | 72 | 67 | 71 | 71 | 73 | 74 | 62 | 75 | 76 | 62 | 63 | 61 |
| 11. Glyma_PHD-zf\IV | 78 | 65 | 64 | 57 | 56 | 72 | 69 | 60 | 70 | 64 | 72 | 72 | 71 | 73 | 68 | 72 | 73 | 75 | 76 | 63 | 77 | 76 | 63 | 64 | 64 |
| 12. Glyma_PHD-zf\V | 70 | 63 | 62 | 57 | 56 | 72 | 69 | 62 | 66 | 62 | 67 | 65 | 65 | 70 | 63 | 70 | 69 | 72 | 75 | 63 | 74 | 74 | 62 | 64 | 63 |
| 13. Glyma_PHD-zf\VI | 79 | 66 | 66 | 57 | 59 | 72 | 70 | 61 | 68 | 63 | 70 | 68 | 66 | 73 | 66 | 70 | 72 | 75 | 79 | 63 | 78 | 77 | 62 | 63 | 61 |
| 14. Glyma_PHD-zf\VII | 60 | 56 | 53 | 70 | 66 | 60 | 58 | 74 | 58 | 55 | 62 | 62 | 62 | 66 | 62 | 64 | 65 | 61 | 65 | 68 | 62 | 60 | 79 | 87 | 85 |
| 15. Horvu_PHD-zf\I | 64 | 80 | 64 | 54 | 54 | 72 | 79 | 54 | 61 | 60 | 61 | 62 | 62 | 63 | 59 | 59 | 61 | 63 | 63 | 58 | 65 | 65 | 53 | 57 | 58 |
| 16. Horvu_PHD-zf\II | 65 | 78 | 64 | 52 | 54 | 72 | 87 | 53 | 59 | 61 | 62 | 64 | 65 | 63 | 61 | 62 | 61 | 65 | 64 | 58 | 70 | 69 | 56 | 60 | 58 |
| 17. Horvu_PHD-zf\III | 55 | 55 | 55 | 64 | 87 | 57 | 56 | 61 | 53 | 53 | 57 | 59 | 59 | 58 | 59 | 58 | 57 | 58 | 58 | 59 | 57 | 55 | 60 | 60 | 61 |
| 18. Horvu_PHD-zf\IV | 62 | 58 | 57 | 54 | 53 | 64 | 60 | 52 | 82 | 57 | 63 | 61 | 62 | 65 | 61 | 64 | 65 | 62 | 68 | 56 | 64 | 66 | 55 | 57 | 56 |

TABLE B4-continued

MatGAT results for global similarity and identity over the full length of the polypeptide sequences of Table A.

| | | | | | | | | | | | | | | | | | | | | | | | | |
|---|---|---|---|---|---|---|---|---|---|---|---|---|---|---|---|---|---|---|---|---|---|---|---|---|
| 19. Lyces__PHD-zf\II | 71 | 65 | 66 | 57 | 59 | 71 | 67 | 59 | 65 | 63 | 66 | 65 | 64 | 68 | 62 | 67 | 65 | 70 | 72 | 59 | 73 | 71 | 63 | 62 | 61 |
| 20. Lyces__PHD-zf\III | 69 | 64 | 64 | 59 | 56 | 75 | 69 | 61 | 67 | 64 | 64 | 65 | 64 | 66 | 62 | 65 | 67 | 69 | 72 | 61 | 72 | 72 | 61 | 67 | 64 |
| 21. Lyces__PHD-zf\IV | 59 | 57 | 55 | 66 | 65 | 62 | 59 | 72 | 58 | 53 | 67 | 67 | 67 | 68 | 67 | 67 | 68 | 60 | 66 | 68 | 64 | 62 | 78 | 82 | 83 |
| 22. Medtr__PHD-zf\I | 74 | 65 | 63 | 57 | 54 | 70 | 69 | 58 | 70 | 58 | 71 | 68 | 67 | 72 | 65 | 71 | 71 | 75 | 75 | 62 | 74 | 76 | 60 | 62 | 62 |
| 23. Medtr__PHD-zf\III | 69 | 62 | 61 | 55 | 55 | 69 | 66 | 56 | 64 | 58 | 69 | 67 | 65 | 69 | 65 | 67 | 68 | 70 | 69 | 59 | 69 | 71 | 58 | 60 | 60 |
| 24. Medtr__PHD-zf\IV | 61 | 57 | 54 | 69 | 65 | 61 | 59 | 73 | 58 | 54 | 64 | 65 | 64 | 66 | 64 | 65 | 66 | 61 | 67 | 68 | 64 | 62 | 78 | 87 | 86 |
| 25. Medtr__PHD-zf\V | 62 | 60 | 61 | 55 | 50 | 67 | 62 | 58 | 64 | 58 | 61 | 61 | 60 | 62 | 58 | 62 | 63 | 66 | 67 | 59 | 68 | 67 | 57 | 60 | 57 |
| 26. Medtr__PHD-zf\VI | | 66 | 63 | 55 | 57 | 67 | 69 | 58 | 65 | 61 | 66 | 67 | 67 | 68 | 64 | 65 | 65 | 69 | 71 | 58 | 72 | 73 | 56 | 63 | 62 |
| 27. Orysa__PHD-zf\I | 74 | | 68 | 49 | 58 | 70 | 79 | 52 | 56 | 60 | 62 | 61 | 60 | 62 | 59 | 58 | 60 | 63 | 65 | 57 | 69 | 65 | 54 | 59 | 56 |
| 28. Orysa__PHD-zf\II | 73 | 78 | | 52 | 57 | 70 | 65 | 54 | 58 | 71 | 60 | 60 | 59 | 61 | 58 | 60 | 59 | 63 | 64 | 55 | 67 | 66 | 52 | 57 | 55 |
| 29. Orysa__PHD-zf\III | 72 | 68 | 67 | | 62 | 55 | 52 | 77 | 54 | 53 | 57 | 58 | 57 | 59 | 59 | 57 | 58 | 58 | 58 | 64 | 57 | 56 | 65 | 67 | 68 |
| 30. Orysa__PHD-zf\IV | 75 | 73 | 67 | 78 | | 57 | 54 | 61 | 54 | 54 | 58 | 58 | 58 | 59 | 57 | 59 | 57 | 57 | 57 | 61 | 58 | 55 | 60 | 62 | 64 |
| 31. Orysa__PHD-zf\IX | 78 | 82 | 80 | 73 | 73 | | 75 | 57 | 63 | 66 | 62 | 64 | 62 | 66 | 61 | 64 | 63 | 70 | 69 | 56 | 73 | 73 | 57 | 62 | 61 |
| 32. Orysa__PHD-zf\VI | 78 | 87 | 79 | 72 | 73 | 86 | | 53 | 59 | 62 | 66 | 64 | 65 | 66 | 61 | 64 | 63 | 64 | 69 | 58 | 70 | 70 | 55 | 60 | 58 |
| 33. Orysa__PHD-zf\VII | 72 | 67 | 67 | 84 | 76 | 70 | 69 | | 55 | 56 | 59 | 61 | 60 | 60 | 61 | 58 | 59 | 58 | 62 | 61 | 60 | 60 | 69 | 71 | 72 |
| 34. Orysa__PHD-zf\VIII | 77 | 72 | 72 | 68 | 71 | 73 | 72 | 68 | | 59 | 63 | 61 | 61 | 65 | 60 | 65 | 66 | 61 | 66 | 57 | 63 | 64 | 57 | 58 | 57 |
| 35. Oyrsa__PHD-zf\IV | 76 | 71 | 81 | 69 | 69 | 79 | 77 | 70 | 70 | | 56 | 57 | 56 | 59 | 56 | 60 | 57 | 60 | 62 | 54 | 63 | 60 | 54 | 53 | 53 |
| 36. Phypa__PHD-zf\I | 82 | 71 | 74 | 79 | 76 | 76 | 77 | 79 | 76 | 71 | | 81 | 81 | 92 | 78 | 89 | 89 | 69 | 72 | 66 | 70 | 72 | 62 | 64 | 65 |
| 37. Phypa__PHD-zf\II | 82 | 74 | 75 | 78 | 76 | 77 | 77 | 76 | 75 | 72 | 88 | | 93 | 81 | 86 | 81 | 80 | 67 | 70 | 61 | 69 | 72 | 62 | 64 | 65 |
| 38. Phypa__PHD-zf\III | 82 | 74 | 75 | 76 | 75 | 77 | 76 | 76 | 72 | 90 | 96 | | 82 | 86 | 81 | 81 | 65 | 69 | 63 | 67 | 73 | 62 | 64 | 64 |
| 39. Phypa__PHD-zf\IV | 83 | 73 | 74 | 79 | 77 | 78 | 78 | 78 | 77 | 72 | 96 | 90 | 93 | | 79 | 93 | 91 | 70 | 73 | 65 | 72 | 72 | 64 | 66 | 66 |
| 40. Phypa__PHD-zf\V | 79 | 72 | 71 | 81 | 78 | 74 | 75 | 78 | 75 | 72 | 87 | 93 | 92 | 86 | | 78 | 78 | 64 | 69 | 62 | 68 | 69 | 62 | 64 | 65 |
| 41. Phypa__PHD-zf\VI | 83 | 71 | 73 | 77 | 78 | 77 | 76 | 75 | 78 | 74 | 93 | 89 | 89 | 96 | 87 | | 90 | 70 | 72 | 63 | 71 | 74 | 64 | 65 | 64 |
| 42. Phypa__PHD-zf\VII | 81 | 69 | 71 | 78 | 75 | 74 | 74 | 76 | 77 | 70 | 92 | 87 | 88 | 93 | 88 | 92 | | 69 | 71 | 62 | 71 | 70 | 65 | 66 | 65 |
| 43. Picsi__PHD-zf\I | 83 | 75 | 75 | 77 | 78 | 82 | 76 | 74 | 75 | 75 | 84 | 84 | 83 | 84 | 80 | 84 | 82 | | 79 | 60 | 78 | 76 | 58 | 62 | 63 |
| 44. Picsi__PHD-zf\II | 84 | 74 | 77 | 75 | 77 | 82 | 80 | 74 | 78 | 77 | 87 | 85 | 85 | 87 | 82 | 88 | 85 | 88 | | 64 | 82 | 79 | 63 | 67 | 65 |
| 45. Picsi__PHD-zf\III | 74 | 72 | 69 | 80 | 79 | 73 | 73 | 77 | 69 | 69 | 82 | 80 | 79 | 82 | 81 | 81 | 79 | 78 | 81 | | 63 | 64 | 64 | 68 | 69 |
| 46. Picsi__PHD-zf\IV | 85 | 77 | 80 | 74 | 78 | 84 | 82 | 73 | 78 | 78 | 81 | 82 | 80 | 83 | 78 | 83 | 80 | 86 | 88 | 78 | | 80 | 61 | 65 | 62 |
| 47. Picsi__PHD-zf\V | 83 | 75 | 78 | 72 | 74 | 83 | 81 | 74 | 77 | 74 | 84 | 83 | 84 | 83 | 80 | 85 | 81 | 86 | 90 | 79 | 89 | | 60 | 63 | 62 |
| 48. Poptr__PHD-zf\I | 72 | 68 | 67 | 79 | 77 | 73 | 68 | 81 | 68 | 70 | 79 | 79 | 77 | 80 | 79 | 78 | 81 | 75 | 77 | 78 | 74 | 73 | | 79 | 78 |
| 49. Poptr__PHD-zf\II | 74 | 69 | 68 | 82 | 79 | 73 | 73 | 83 | 70 | 66 | 80 | 79 | 79 | 80 | 81 | 80 | 81 | 76 | 79 | 81 | 76 | 76 | 88 | | 93 |
| 50. Poptr__PHD-zf\III | 74 | 68 | 67 | 82 | 79 | 73 | 72 | 84 | 69 | 66 | 80 | 80 | 78 | 80 | 81 | 79 | 81 | 76 | 78 | 80 | 76 | 77 | 89 | 96 | |
| 51. Poptr__PHD-zf\IV | 72 | 68 | 68 | 79 | 78 | 73 | 68 | 81 | 68 | 70 | 78 | 79 | 79 | 80 | 79 | 78 | 81 | 74 | 76 | 80 | 73 | 74 | 95 | 88 | 89 |
| 52. Poptr__PHD-zf\V | 88 | 78 | 78 | 76 | 77 | 84 | 79 | 78 | 81 | 77 | 86 | 87 | 85 | 85 | 85 | 87 | 82 | 89 | 90 | 81 | 88 | 88 | 78 | 78 | 78 |
| 53. Poptr__PHD-zf\VI | 87 | 77 | 78 | 73 | 76 | 82 | 79 | 75 | 82 | 75 | 84 | 84 | 84 | 84 | 82 | 85 | 82 | 86 | 88 | 78 | 87 | 87 | 74 | 77 | 77 |
| 54. Poptr__PHD-zf\VII | 80 | 75 | 75 | 72 | 71 | 80 | 78 | 72 | 76 | 74 | 80 | 80 | 78 | 82 | 78 | 82 | 80 | 82 | 84 | 77 | 82 | 84 | 73 | 74 | 73 |
| 55. Poptr__PHD-zf\VIII | 81 | 75 | 74 | 73 | 71 | 80 | 79 | 72 | 76 | 74 | 80 | 80 | 79 | 81 | 78 | 82 | 80 | 82 | 84 | 76 | 82 | 84 | 72 | 74 | 72 |
| 56. Roshy__PHD-zf\ | 74 | 70 | 68 | 81 | 80 | 74 | 72 | 84 | 71 | 68 | 81 | 80 | 80 | 82 | 83 | 80 | 83 | 77 | 80 | 81 | 76 | 76 | 89 | 90 | 91 |
| 57. Sacof__PHD-zf\II | 77 | 79 | 79 | 71 | 73 | 90 | 83 | 70 | 74 | 76 | 76 | 78 | 76 | 77 | 73 | 77 | 73 | 80 | 79 | 73 | 82 | 81 | 69 | 72 | 72 |
| 58. Sacof__PHD-zf\III | 76 | 85 | 79 | 74 | 73 | 88 | 94 | 73 | 72 | 76 | 76 | 76 | 78 | 76 | 76 | 73 | 77 | 79 | 72 | 81 | 80 | 69 | 72 | 73 |
| 59. Sacof__PHD-zf\IV | 72 | 67 | 68 | 78 | 82 | 72 | 71 | 75 | 66 | 67 | 75 | 76 | 74 | 75 | 77 | 74 | 77 | 72 | 76 | 79 | 74 | 72 | 79 | 81 | 81 |
| 60. Sacof__PHD-zf\V | 72 | 69 | 68 | 86 | 75 | 73 | 71 | 84 | 68 | 69 | 78 | 79 | 79 | 80 | 79 | 77 | 77 | 77 | 76 | 80 | 78 | 75 | 75 | 79 | 78 |
| 61. Tager__PHD-zf | 70 | 65 | 64 | 79 | 74 | 69 | 68 | 79 | 69 | 66 | 78 | 77 | 77 | 79 | 79 | 77 | 78 | 71 | 76 | 79 | 73 | 72 | 81 | 86 | 87 |
| 62. Triae__PHD-zf\I | 77 | 73 | 71 | 70 | 70 | 73 | 71 | 69 | 89 | 71 | 77 | 77 | 75 | 76 | 75 | 76 | 77 | 78 | 70 | 78 | 78 | 68 | 69 | 70 |
| 63. Triae__PHD-zf\II | 76 | 78 | 79 | 72 | 71 | 96 | 85 | 69 | 73 | 81 | 77 | 76 | 77 | 78 | 75 | 78 | 76 | 81 | 80 | 71 | 82 | 83 | 71 | 72 | 72 |
| 64. Vitivi__PHD-zf\I | 78 | 72 | 68 | 83 | 80 | 75 | 73 | 85 | 70 | 71 | 82 | 82 | 81 | 84 | 84 | 81 | 84 | 78 | 80 | 82 | 77 | 77 | 86 | 92 | 92 |
| 65. Vitivi__PHD-zf\II | 89 | 78 | 78 | 74 | 77 | 84 | 80 | 75 | 80 | 77 | 85 | 86 | 85 | 86 | 83 | 87 | 85 | 87 | 89 | 79 | 88 | 88 | 77 | 78 | 76 |
| 66. Vitivi__PHD-zf\III | 72 | 67 | 68 | 82 | 80 | 72 | 69 | 82 | 69 | 71 | 79 | 79 | 78 | 81 | 79 | 79 | 81 | 76 | 78 | 81 | 75 | 73 | 86 | 88 | 89 |
| 67. Vitivi__PHD-zf\IV | 81 | 75 | 78 | 73 | 73 | 81 | 78 | 74 | 76 | 76 | 80 | 79 | 80 | 80 | 78 | 80 | 78 | 80 | 85 | 77 | 82 | 83 | 70 | 73 | 72 |
| 68. Zeama__PHD-zf\I | 80 | 79 | 90 | 71 | 74 | 85 | 83 | 70 | 71 | 83 | 77 | 77 | 78 | 77 | 75 | 76 | 75 | 79 | 81 | 75 | 81 | 82 | 72 | 73 | 71 |
| 69. Zeama__PHD-zf\II | 75 | 85 | 78 | 74 | 71 | 86 | 93 | 72 | 72 | 75 | 73 | 76 | 76 | 75 | 74 | 75 | 73 | 77 | 79 | 72 | 79 | 79 | 69 | 72 | 73 |
| 70. Zeama__PHD-zf\III | 60 | 62 | 62 | 73 | 71 | 63 | 63 | 73 | 65 | 63 | 64 | 65 | 64 | 66 | 66 | 66 | 65 | 67 | 66 | 67 | 66 | 66 | 67 | 68 | 69 |
| 71. Zeama__PHD-zf\IV | 72 | 67 | 41 | 79 | 82 | 71 | 71 | 78 | 69 | 68 | 76 | 75 | 75 | 76 | 77 | 75 | 78 | 74 | 76 | 79 | 74 | 74 | 80 | 83 | 83 |

| | 51 | 52 | 53 | 54 | 55 | 56 | 57 | 58 | 59 | 60 | 61 | 62 | 63 | 64 | 65 | 66 | 67 | 68 | 69 | 70 | 71 |
|---|---|---|---|---|---|---|---|---|---|---|---|---|---|---|---|---|---|---|---|---|---|
| **1. Lyces__PHD-zf*\I | 68 | 62 | 59 | 55 | 56 | 68 | 55 | 57 | 60 | 59 | 67 | 54 | 56 | 71 | 61 | 68 | 57 | 56 | 56 | 49 | 60** |
| 2. Arath__PHD-zf\I | 58 | 69 | 67 | 81 | 80 | 57 | 67 | 66 | 56 | 58 | 56 | 62 | 71 | 63 | 70 | 58 | 80 | 65 | 65 | 46 | 56 |
| 3. Arath__PHD-zf\II | 77 | 64 | 62 | 64 | 63 | 75 | 58 | 60 | 62 | 65 | 72 | 58 | 60 | 77 | 64 | 71 | 62 | 59 | 60 | 55 | 63 |
| 4. Arath__PHD-zf\III | 62 | 78 | 74 | 69 | 68 | 61 | 64 | 65 | 57 | 54 | 59 | 65 | 66 | 64 | 78 | 60 | 70 | 65 | 66 | 45 | 56 |
| 5. Arath__PHD-zf\IV | 55 | 79 | 73 | 67 | 67 | 58 | 63 | 65 | 57 | 52 | 56 | 65 | 67 | 61 | 77 | 58 | 67 | 63 | 64 | 46 | 57 |
| 6. Arath__PHD-zf\V | 76 | 63 | 62 | 64 | 64 | 75 | 56 | 58 | 62 | 63 | 71 | 57 | 58 | 79 | 63 | 72 | 63 | 57 | 57 | 52 | 63 |
| 7. Chlre__PHD-zf | 49 | 46 | 44 | 49 | 48 | 52 | 44 | 44 | 49 | 44 | 48 | 45 | 47 | 51 | 46 | 48 | 47 | 44 | 43 | 38 | 48 |
| 8. Glyma__PHD-zf\I | 61 | 85 | 81 | 76 | 74 | 60 | 66 | 69 | 58 | 56 | 57 | 68 | 72 | 64 | 86 | 63 | 72 | 67 | 69 | 47 | 32 |
| 9. Glyma__PHD-zf\II | 59 | 87 | 85 | 69 | 68 | 60 | 67 | 69 | 57 | 56 | 59 | 67 | 72 | 64 | 89 | 62 | 68 | 69 | 70 | 48 | 57 |
| 10. Glyma__PHD-zf\III | 60 | 80 | 77 | 74 | 72 | 61 | 65 | 65 | 57 | 54 | 57 | 65 | 71 | 65 | 81 | 61 | 70 | 66 | 65 | 45 | 56 |
| 11. Glyma__PHD-zf\IV | 62 | 88 | 82 | 72 | 71 | 61 | 66 | 71 | 57 | 57 | 58 | 68 | 71 | 64 | 88 | 61 | 70 | 68 | 70 | 47 | 57 |
| 12. Glyma__PHD-zf\V | 60 | 73 | 72 | 87 | 87 | 60 | 66 | 69 | 55 | 56 | 59 | 64 | 72 | 67 | 75 | 61 | 84 | 67 | 68 | 47 | 56 |
| 13. Glyma__PHD-zf\VI | 62 | 87 | 85 | 72 | 70 | 62 | 67 | 69 | 60 | 57 | 58 | 68 | 72 | 66 | 88 | 64 | 72 | 68 | 68 | 48 | 59 |
| 14. Glyma__PHD-zf\VII | 77 | 64 | 64 | 62 | 61 | 79 | 57 | 58 | 66 | 65 | 73 | 56 | 60 | 86 | 63 | 81 | 61 | 58 | 57 | 55 | 65 |
| 15. Horvu__PHD-zf\I | 53 | 67 | 66 | 63 | 62 | 53 | 68 | 79 | 55 | 51 | 54 | 61 | 69 | 59 | 70 | 56 | 64 | 66 | 79 | 42 | 54 |
| 16. Horvu__PHD-zf\II | 54 | 70 | 68 | 66 | 67 | 55 | 66 | 86 | 57 | 52 | 54 | 59 | 70 | 61 | 71 | 54 | 67 | 67 | 83 | 44 | 33 |
| 17. Horvu__PHD-zf\III | 58 | 58 | 55 | 55 | 54 | 62 | 56 | 55 | 74 | 58 | 56 | 54 | 55 | 62 | 57 | 64 | 57 | 58 | 56 | 53 | 74 |
| 18. Horvu__PHD-zf\IV | 55 | 69 | 67 | 64 | 63 | 56 | 59 | 58 | 54 | 52 | 54 | 93 | 63 | 57 | 69 | 56 | 65 | 59 | 57 | 43 | 54 |
| 19. Lyces__PHD-zf\II | 62 | 78 | 76 | 70 | 68 | 60 | 67 | 66 | 59 | 55 | 58 | 65 | 70 | 64 | 79 | 63 | 68 | 68 | 65 | 46 | 59 |
| 20. Lyces__PHD-zf\III | 61 | 74 | 72 | 83 | 82 | 61 | 69 | 68 | 58 | 57 | 58 | 64 | 73 | 66 | 74 | 61 | 82 | 68 | 68 | 48 | 58 |
| 21. Lyces__PHD-zf\IV | 78 | 65 | 64 | 63 | 62 | 81 | 59 | 59 | 67 | 64 | 75 | 58 | 60 | 85 | 64 | 78 | 63 | 60 | 59 | 55 | 36 |
| 22. Medtr__PHD-zf\I | 60 | 83 | 81 | 74 | 72 | 59 | 67 | 69 | 56 | 58 | 59 | 67 | 69 | 65 | 84 | 61 | 71 | 64 | 67 | 47 | 55 |

TABLE B4-continued

MatGAT results for global similarity and identity over the full length of the polypeptide sequences of Table A.

| | | | | | | | | | | | | | | | | | | | | | |
|---|---|---|---|---|---|---|---|---|---|---|---|---|---|---|---|---|---|---|---|---|---|
| 23. Medtr_PHD-zf\III | 57 | 73 | 72 | 70 | 69 | 58 | 65 | 65 | 57 | 53 | 56 | 61 | 68 | 61 | 76 | 62 | 69 | 62 | 64 | 45 | 57 |
| 24. Medtr_PHD-zf\IV | 76 | 64 | 63 | 62 | 61 | 80 | 55 | 60 | 65 | 66 | 72 | 57 | 59 | 86 | 62 | 79 | 61 | 57 | 58 | 56 | 66 |
| 25. Medtr_PHD-zf\V | 57 | 69 | 65 | 77 | 77 | 55 | 63 | 63 | 51 | 54 | 55 | 63 | 67 | 60 | 69 | 60 | 77 | 63 | 62 | 44 | 32 |
| 26. Medtr_PHD-zf\VI | 57 | 77 | 75 | 67 | 67 | 58 | 64 | 67 | 54 | 54 | 56 | 61 | 67 | 62 | 79 | 57 | 69 | 68 | 66 | 45 | 54 |
| 27. Orysa_PHD-zf\I | 53 | 68 | 67 | 63 | 63 | 53 | 68 | 78 | 55 | 49 | 53 | 56 | 67 | 59 | 70 | 54 | 64 | 67 | 77 | 44 | 55 |
| 28. Orysa_PHD-zf\II | 53 | 67 | 65 | 63 | 62 | 53 | 68 | 65 | 56 | 52 | 51 | 56 | 70 | 56 | 67 | 53 | 66 | 84 | 65 | 48 | 31 |
| 29. Orysa_PHD-zf\III | 64 | 58 | 55 | 59 | 59 | 65 | 53 | 55 | 63 | 76 | 63 | 53 | 55 | 70 | 57 | 71 | 58 | 54 | 54 | 63 | 63 |
| 30. Orysa_PHD-zf\IV | 59 | 57 | 55 | 55 | 54 | 62 | 57 | 55 | 76 | 58 | 58 | 53 | 54 | 62 | 58 | 66 | 56 | 59 | 54 | 55 | 76 |
| 31. Orysa_PHD-zf\IX | 57 | 73 | 70 | 71 | 70 | 57 | 81 | 76 | 58 | 54 | 56 | 61 | 95 | 61 | 73 | 58 | 72 | 73 | 76 | 48 | 57 |
| 32. Orysa_PHD-zf\VI | 54 | 70 | 70 | 68 | 68 | 55 | 70 | 92 | 56 | 53 | 55 | 59 | 75 | 60 | 73 | 55 | 68 | 69 | 90 | 46 | 57 |
| 33. Orysa_PHD-zf\VII | 67 | 60 | 58 | 62 | 61 | 70 | 53 | 55 | 62 | 75 | 65 | 51 | 57 | 74 | 58 | 70 | 60 | 57 | 55 | 64 | 63 |
| 34. Orysa_PHD-zf\VIII | 56 | 69 | 69 | 67 | 66 | 56 | 60 | 59 | 55 | 54 | 54 | 82 | 63 | 59 | 70 | 56 | 63 | 59 | 59 | 45 | 54 |
| 35. Oyrsa_PHD-zf\IV | 53 | 63 | 59 | 65 | 64 | 54 | 62 | 63 | 57 | 55 | 51 | 57 | 65 | 56 | 64 | 55 | 64 | 74 | 62 | 46 | 57 |
| 36. Phypa_PHD-zf\I | 62 | 73 | 71 | 67 | 66 | 61 | 59 | 63 | 59 | 57 | 63 | 63 | 63 | 66 | 74 | 63 | 65 | 63 | 63 | 45 | 60 |
| 37. Phypa_PHD-zf\II | 63 | 72 | 70 | 65 | 64 | 61 | 59 | 64 | 59 | 59 | 61 | 63 | 64 | 65 | 73 | 59 | 66 | 64 | 65 | 45 | 59 |
| 38. Phypa_PHD-zf\III | 62 | 70 | 68 | 65 | 66 | 61 | 59 | 65 | 59 | 59 | 61 | 61 | 64 | 65 | 72 | 58 | 67 | 63 | 65 | 46 | 60 |
| 39. Phypa_PHD-zf\IV | 64 | 75 | 74 | 70 | 68 | 62 | 61 | 64 | 59 | 59 | 63 | 65 | 66 | 68 | 77 | 65 | 67 | 64 | 64 | 47 | 59 |
| 40. Phypa_PHD-zf\V | 62 | 70 | 67 | 66 | 66 | 64 | 58 | 61 | 60 | 57 | 61 | 61 | 61 | 66 | 71 | 60 | 64 | 61 | 62 | 47 | 61 |
| 41. Phypa_PHD-zf\VI | 62 | 74 | 71 | 70 | 69 | 63 | 60 | 61 | 58 | 57 | 61 | 64 | 65 | 67 | 76 | 63 | 67 | 64 | 61 | 47 | 58 |
| 42. Phypa_PHD-zf\VII | 64 | 73 | 71 | 68 | 68 | 64 | 57 | 62 | 58 | 58 | 63 | 66 | 65 | 68 | 76 | 64 | 66 | 63 | 62 | 48 | 59 |
| 43. Picsi_PHD-zf\I | 56 | 78 | 72 | 71 | 71 | 58 | 65 | 65 | 57 | 55 | 54 | 61 | 70 | 61 | 77 | 59 | 67 | 66 | 65 | 47 | 58 |
| 44. Picsi_PHD-zf\II | 62 | 79 | 76 | 74 | 74 | 61 | 64 | 67 | 58 | 57 | 60 | 66 | 67 | 67 | 79 | 64 | 71 | 65 | 68 | 48 | 58 |
| 45. Picsi_PHD-zf\III | 66 | 64 | 62 | 62 | 61 | 65 | 55 | 56 | 60 | 60 | 61 | 55 | 56 | 69 | 63 | 66 | 61 | 57 | 58 | 50 | 61 |
| 46. Picsi_PHD-zf\IV | 59 | 80 | 78 | 72 | 72 | 59 | 67 | 69 | 58 | 57 | 57 | 64 | 72 | 65 | 81 | 61 | 72 | 67 | 69 | 48 | 58 |
| 47. Picsi_PHD-zf\V | 60 | 80 | 78 | 74 | 73 | 58 | 68 | 70 | 58 | 57 | 56 | 65 | 74 | 63 | 81 | 58 | 73 | 70 | 69 | 45 | 59 |
| 48. Poptr_PHD-zf\I | 92 | 61 | 61 | 59 | 58 | 81 | 54 | 55 | 63 | 60 | 71 | 56 | 57 | 78 | 63 | 76 | 60 | 57 | 54 | 54 | 64 |
| 49. Poptr_PHD-zf\II | 77 | 64 | 64 | 62 | 62 | 77 | 57 | 60 | 64 | 66 | 74 | 56 | 61 | 86 | 65 | 74 | 61 | 61 | 60 | 54 | 64 |
| 50. Poptr_PHD-zf\III | 76 | 64 | 62 | 60 | 60 | 77 | 57 | 60 | 65 | 65 | 73 | 56 | 59 | 84 | 62 | 74 | 60 | 59 | 59 | 55 | 66 |
| 51. Poptr_PHD-zf\IV | | 61 | 60 | 58 | 57 | 79 | 53 | 55 | 61 | 61 | 70 | 56 | 57 | 78 | 62 | 76 | 59 | 56 | 54 | 55 | 63 |
| 52. Poptr_PHD-zf\V | 77 | | 86 | 72 | 70 | 62 | 67 | 72 | 57 | 57 | 59 | 68 | 72 | 67 | 91 | 62 | 71 | 69 | 72 | 48 | 57 |
| 53. Poptr_PHD-zf\VI | 73 | 92 | | 70 | 69 | 60 | 67 | 70 | 57 | 55 | 59 | 68 | 70 | 65 | 91 | 61 | 70 | 67 | 69 | 48 | 57 |
| 54. Poptr_PHD-zf\VII | 71 | 83 | 82 | | 97 | 58 | 67 | 70 | 57 | 57 | 56 | 64 | 70 | 64 | 72 | 60 | 86 | 67 | 68 | 47 | 57 |
| 55. Poptr_PHD-zf\VIII | 70 | 83 | 82 | 99 | | 56 | 67 | 69 | 56 | 57 | 55 | 64 | 69 | 63 | 71 | 59 | 85 | 66 | 67 | 47 | 57 |
| 56. Roshy_PHD-zf\ | 90 | 79 | 78 | 75 | 74 | | 55 | 57 | 64 | 62 | 68 | 55 | 57 | 77 | 61 | 77 | 59 | 57 | 55 | 53 | 63 |
| 57. Sacof_PHD-zf\II | 69 | 82 | 81 | 80 | 80 | 74 | | 68 | 57 | 52 | 55 | 60 | 79 | 57 | 68 | 55 | 68 | 69 | 67 | 49 | 56 |
| 58. Sacof_PHD-zf\III | 70 | 80 | 79 | 80 | 80 | 73 | 83 | | 58 | 55 | 56 | 59 | 75 | 62 | 72 | 57 | 69 | 71 | 97 | 45 | 57 |
| 59. Sacof_PHD-zf\IV | 79 | 74 | 75 | 69 | 69 | 79 | 70 | 71 | | 58 | 60 | 54 | 56 | 64 | 59 | 65 | 56 | 58 | 57 | 51 | 96 |
| 60. Sacof_PHD-zf\V | 76 | 78 | 75 | 76 | 76 | 78 | 70 | 70 | 75 | | 57 | 50 | 53 | 68 | 57 | 64 | 56 | 54 | 52 | 60 | 58 |
| 61. Tager_PHD-zf | 82 | 74 | 74 | 71 | 71 | 83 | 69 | 70 | 77 | 77 | | 54 | 55 | 74 | 59 | 69 | 56 | 54 | 56 | 49 | 61 |
| 62. Triae_PHD-zf\I | 68 | 81 | 81 | 77 | 76 | 71 | 75 | 73 | 68 | 67 | 68 | | 63 | 58 | 69 | 56 | 65 | 57 | 58 | 43 | 54 |
| 63. Triae_PHD-zf\II | 71 | 83 | 80 | 80 | 80 | 74 | 88 | 85 | 71 | 70 | 67 | 74 | | 60 | 73 | 58 | 72 | 73 | 73 | 46 | 56 |
| 64. Vitvi_PHD-zf\I | 87 | 81 | 78 | 75 | 74 | 88 | 72 | 75 | 81 | 81 | 87 | 71 | 73 | | 65 | 80 | 64 | 59 | 61 | 57 | 64 |
| 65. Vitvi_PHD-zf\II | 76 | 95 | 94 | 82 | 82 | 80 | 80 | 78 | 75 | 76 | 73 | 81 | 82 | 80 | | 62 | 73 | 70 | 73 | 48 | 58 |
| 66. Vitvi_PHD-zf\III | 87 | 78 | 76 | 74 | 74 | 88 | 72 | 69 | 79 | 78 | 79 | 70 | 71 | 89 | 76 | | 58 | 56 | 57 | 66 |
| 67. Vitvi_PHD-zf\IV | 70 | 85 | 84 | 93 | 92 | 74 | 80 | 79 | 71 | 75 | 71 | 77 | 82 | 74 | 85 | 72 | | 69 | 68 | 47 | 57 |
| 68. Zeama_PHD-zf\I | 73 | 81 | 80 | 78 | 78 | 72 | 82 | 83 | 72 | 71 | 68 | 71 | 84 | 73 | 80 | 71 | 81 | | 70 | 48 | 58 |
| 69. Zeama_PHD-zf\II | 70 | 79 | 78 | 78 | 78 | 72 | 81 | 98 | 71 | 70 | 70 | 71 | 84 | 75 | 79 | 70 | 79 | 82 | | 46 | 56 |
| 70. Zeama_PHD-zf\III | 69 | 65 | 65 | 65 | 64 | 69 | 64 | 63 | 64 | 71 | 63 | 64 | 62 | 70 | 66 | 68 | 64 | 62 | 62 | | 51 |
| 71. Zeama_PHD-zf\IV | 80 | 74 | 74 | 71 | 71 | 80 | 69 | 71 | 98 | 76 | 78 | 70 | 71 | 82 | 74 | 81 | 72 | 73 | 70 | 66 | |

The percentage amino acid identity can be significantly increased if the most conserved region of the polypeptides are compared. For example, when comparing the amino acid sequence of the Conserved Domain of SEQ ID NO: 348 (as represented by SEQ ID NO: 491), with the Conserved Domain of the polypeptides of Table A4, the percentage amino acid identity increases up to 70% or more.

3.5. REF/ALY Polypeptides

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:

Scoring matrix: Blosum62

First Gap: 12

Extending gap: 2

Results of the software analysis are shown in Table B5 for the global similarity and identity over the full length of the polypeptide sequences. Percentage identity is given above the diagonal in bold and percentage similarity is given below the diagonal (normal face).

The percentage identity between the REF/ALY polypeptide sequences of Table A5 and SEQ ID NO: 498 was at least of 31.9%.

TABLE B5

MatGAT results for global similarity and identity over the full length of the polypeptide sequences.

|  | 1 | 2 | 3 | 4 | 5 | 6 | 7 | 8 | 9 | 10 |
|---|---|---|---|---|---|---|---|---|---|---|
| 1. N.tabacum__CAG26903.1 |  | 57.8 | 59.8 | 57.0 | 49.6 | 59.3 | 29.2 | 53.2 | 65.8 | 58.6 |
| 2. N.tabacum__CAG26902.1 | 71.0 |  | 94.4 | 52.7 | 45.4 | 54.7 | 27.3 | 51.1 | 56.9 | 52.2 |
| 3. N.tabacum__CAJ44457.1 | 71.8 | 97.2 |  | 53.5 | 47.2 | 58.1 | 27.7 | 51.4 | 58.4 | 54.2 |
| 4. O.sativa__Os03g0278300 | 64.8 | 62.6 | 63.4 |  | 44.5 | 54.9 | 39.3 | 76.3 | 57.9 | 51.5 |
| 5. A.thaliana__AT5G59950 | 60.0 | 59.4 | 59.8 | 53.8 |  | 78.7 | 31.9 | 42.7 | 47.7 | 52.7 |
| 6. A.thaliana__At5g59950__long | 70.6 | 69.5 | 70.7 | 66.7 | 79.9 |  | 28.6 | 52.0 | 57.7 | 54.3 |
| 7. H.vulgare__BF2629051 | 41.6 | 40.2 | 39.8 | 45.4 | 46.9 | 41.4 |  | 49.6 | 27.9 | 31.2 |
| 8. H.vulgare__TA34369_45131 | 66.3 | 63.4 | 63.7 | 83.9 | 54.6 | 65.6 | 52.7 |  | 52.8 | 48.6 |
| 9. M.truncatula__TA20993_38801 | 75.3 | 69.6 | 69.6 | 67.8 | 57.4 | 70.7 | 39.5 | 65.9 |  | 84.0 |
| 10. M.truncatula__BG5813671 | 68.6 | 63.9 | 64.6 | 59.3 | 64.0 | 68.9 | 42.8 | 60.4 | 84.4 |  |
| 11. P.trichocarpa__scaff_226.111 | 70.6 | 73.1 | 74.4 | 67.4 | 60.4 | 73.1 | 41.2 | 67.4 | 74.9 | 69.4 |
| 12. P.trichocarpa__scaff_I.16411 | 57.3 | 55.4 | 55.3 | 51.3 | 68.7 | 59.4 | 53.0 | 52.0 | 58.2 | 64.4 |
| 13. S.lycopersicum__TA41256_40811 | 87.8 | 73.7 | 72.5 | 64.5 | 62.2 | 74.9 | 41.0 | 68.5 | 74.5 | 68.5 |
| 14. S.lycopersicum__AW9285861 | 48.2 | 43.8 | 42.7 | 36.6 | 50.2 | 43.4 | 53.8 | 41.0 | 41.4 | 46.2 |
| 15. T.aestivum__TA72566_45651 | 67.2 | 65.3 | 65.3 | 81.3 | 55.0 | 64.1 | 51.1 | 93.4 | 68.4 | 63.0 |
| 16. T.aestivum__TA72565_45651 | 54.5 | 54.6 | 55.3 | 60.1 | 63.0 | 54.5 | 69.5 | 70.0 | 53.6 | 60.6 |
| 17. Z.mays__AY104617 | 52.9 | 50.0 | 52.2 | 64.3 | 48.1 | 50.3 | 37.6 | 64.3 | 53.8 | 50.6 |
| 18. T.aestivum__BT009294 | 50.6 | 49.8 | 50.0 | 61.2 | 51.2 | 54.1 | 25.9 | 67.0 | 50.2 | 49.6 |
| 19. Z.mays__ZM07MC203651 | 60.6 | 61.7 | 62.5 | 79.1 | 53.1 | 60.3 | 41.5 | 76.2 | 63.5 | 56.7 |
| 20. G.max__GM06MC147591 | 76.1 | 71.1 | 72.4 | 66.7 | 64.6 | 75.4 | 44.0 | 67.4 | 79.8 | 75.3 |
| 21. G.max__GM06MC115191 | 76.1 | 73.1 | 73.3 | 66.7 | 61.9 | 76.5 | 42.1 | 65.6 | 85.9 | 80.6 |

|  | 11 | 12 | 13 | 14 | 15 | 16 | 17 | 18 | 19 | 20 |
|---|---|---|---|---|---|---|---|---|---|---|
| 1. N.tabacum__CAG26903.1 | 61.0 | 50.4 | 83.7 | 45.5 | 55.4 | 43.2 | 42.9 | 41.8 | 50.5 | 69.5 |
| 2. N.tabacum__CAG26902.1 | 58.9 | 46.0 | 59.5 | 34.5 | 52.8 | 41.3 | 41.3 | 41.1 | 50.5 | 58.7 |
| 3. N.tabacum__CAJ44457.1 | 61.3 | 46.6 | 59.0 | 33.7 | 53.2 | 42.0 | 42.8 | 41.2 | 50.9 | 60.3 |
| 4. O.sativa__Os03g0278300 | 56.1 | 43.2 | 55.6 | 31.4 | 74.7 | 55.1 | 56.6 | 56.3 | 68.7 | 55.1 |
| 5. A.thaliana__AT5G59950 | 47.6 | 58.2 | 49.6 | 38.4 | 43.5 | 46.0 | 37.8 | 32.2 | 42.1 | 51.4 |
| 6. A.thaliana__At5g59950__long | 58.9 | 50.4 | 60.4 | 33.3 | 51.5 | 40.2 | 39.7 | 40.6 | 48.0 | 61.0 |
| 7. H.vulgare__BF2629051 | 28.5 | 35.3 | 29.5 | 40.6 | 43.2 | 60.0 | 30.1 | 16.0 | 33.9 | 27.8 |
| 8. H.vulgare__TA34369_45131 | 53.8 | 41.8 | 54.0 | 32.2 | 89.7 | 65.6 | 52.8 | 64.8 | 62.2 | 52.5 |
| 9. M.truncatula__TA20993_38801 | 62.8 | 50.8 | 65.9 | 36.2 | 53.8 | 41.4 | 44.0 | 40.6 | 52.6 | 73.3 |
| 10. M.truncatula__BG5813671 | 55.9 | 56.5 | 58.6 | 40.3 | 50.6 | 46.2 | 43.8 | 36.8 | 48.2 | 67.3 |
| 11. P.trichocarpa__scaff_226.111 |  | 48.8 | 62.4 | 33.9 | 53.9 | 41.7 | 41.3 | 45.3 | 51.1 | 68.1 |
| 12. P.trichocarpa__scaff_I.16411 | 60.0 |  | 49.8 | 45.6 | 42.2 | 52.5 | 38.2 | 31.5 | 43.3 | 54.7 |
| 13. S.lycopersicum__TA41256_40811 | 71.7 | 59.8 |  | 54.6 | 54.5 | 44.9 | 42.9 | 41.9 | 51.2 | 68.7 |
| 14. S.lycopersicum__AW9285861 | 41.2 | 59.7 | 55.0 |  | 31.7 | 43.0 | 27.2 | 20.1 | 30.8 | 38.6 |
| 15. T.aestivum__TA72566_45651 | 70.2 | 53.4 | 68.3 | 40.1 |  | 68.9 | 51.7 | 72.1 | 61.8 | 55.8 |
| 16. T.aestivum__TA72565_45651 | 56.7 | 68.5 | 59.0 | 55.3 | 71.0 |  | 42.1 | 42.6 | 47.9 | 43.5 |
| 17. Z.mays__AY104617 | 52.5 | 45.2 | 53.2 | 32.5 | 61.1 | 50.3 |  | 36.9 | 75.6 | 42.7 |
| 18. T.aestivum__BT009294 | 58.4 | 51.3 | 52.6 | 32.3 | 72.1 | 58.4 | 43.9 |  | 45.4 | 44.7 |
| 19. Z.mays__ZM07MC203651 | 63.2 | 51.3 | 61.4 | 36.8 | 74.0 | 57.0 | 79.0 | 54.5 |  | 51.8 |
| 20. G.max__GM06MC147591 | 82.9 | 64.2 | 77.3 | 46.5 | 69.1 | 57.6 | 52.2 | 56.0 | 61.7 |  |
| 21. G.max__GM06MC115191 | 81.0 | 63.2 | 80.5 | 47.4 | 66.4 | 55.9 | 53.2 | 52.6 | 64.3 | 84.6 |

Example 4

Identification of Domains Comprised in Polypeptide Sequences Useful in Performing the Methods of the Invention The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, ProDom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

4.1. TFL1-Like Polypeptides

The results of the InterPro scan of the polypeptide sequence as represented by SEQ ID NO: 2 are presented in Table C1.

TABLE C1

InterPro scan results (major accession numbers) of the polypeptide sequence as represented by SEQ ID NO: 2.

| Database | Accession number | Accession name | Amino acid coordinates on SEQ ID NO 2 |
|---|---|---|---|
| Interpro | InterPro:IPR008914 | Phosphatidylethanolamine-binding protein PEBP | 12-170 |
| superfam | 49777 |  | 12-169 |

TABLE C1-continued

InterPro scan results (major accession numbers) of the polypeptide sequence as represented by SEQ ID NO: 2.

| Database | Accession number | Accession name | Amino acid coordinates on SEQ ID NO 2 |
|---|---|---|---|
| prodom | PD004330 | Phosphatidylethanolamine-binding protein PEBP | 12-170 |
| prosite | PS01220 | Phosphatidylethanolamine-binding, conserved site | 66-88 |
| pfam | PF01161 | Phosphatidylethanolamine-binding protein PEBP | 20-167 |
| superfam | PTHR11362 |  | 21-175 |
| superfam | SSF49777 | Phosphatidylethanolamine-binding protein PEBP | 12-170 |
| superfam | G3DSA:3.90.280.10 | Phosphatidylethanolamine-binding protein PEBP | 6-175 |

4.2. Ribose 5-Phosphate Isomerase (R5PI)

The results of the InterPro scan of the polypeptide sequence as represented by the polypeptide A.thaliana_T1G71100 above referred are presented in Table C2.

TABLE C2

InterPro scan results of the polypeptide sequence as represented by A. thaliana AT1G71100 polypeptide

| Database | Accession Number | Description | E-value | Amino acid coordinates in polypeptide A.thaliana__AT1G71100 |
|---|---|---|---|---|
| InterPro | IPR004788 | Ribose 5-phosphate isomerase |  |  |
| PRODOM | PD005813 | RpiA | 0.0 | [35-155] |
| PANTHER | PTHR11934 | RpiA | 1.1E−120 | [1-265] |
| PFAM | PF06026 | Rib_5-P_isom_A | 7.1E−87 | [77-261] |
| TIGRFAMs | TIGR00021 | rpiA | 5.9E−105 | [32-261] |
| GENE3D | G3DSA:3.40.50.1360 | G3DSA:3.40.50.1360 | 2.1E−48 | [27-177] |
| SUPERFAMILY | SSF100950 | SSF100950 | 3.3E−42 | [28-179] |
| SUPERFAMILY | SSF75445 | SSF75445 | 6.5E−16 | [158-246] |

4.3. Zinc Finger (Znf) Domain-Containing A20/AN1 Polypeptide

The results of the InterPro scan of the polypeptide sequence as represented by SEQ ID NO: 213 are presented in Table C3.

TABLE C3

InterPro scan results of the polypeptide sequence as represented by SEQ ID NO: 213

| InterPro accession number and name | Integrated database name | Integrated database accession number | Integrated database accession name |
|---|---|---|---|
| IPR000058 Zinc finger, AN1-type | PFAM | PF01428 | zf-AN1 |
| IPR000058 Zinc finger, AN1-type | ProSite | PS51039 | ZF_AN1 |
| IPR000058 Zinc finger, AN1-type | SMART | SM00154 | ZnF_AN1 |
| IPR002653 Zinc finger, A20-type | PSORT | PS51036 | ZF_A20 |

4.4. PHD-zf Polypeptide

The results of the InterPro scan of the polypeptide sequence as represented by SEQ ID NO: 348 are presented in Table C4.

TABLE C4

InterPro scan results of the polypeptide sequence as represented by SEQ ID NO: 348

| InterPro accession number and name | Integrated database name | Integrated database accession number | Integrated database accession name |
|---|---|---|---|
| IPR001965 Zinc finger, PHD-type | PFAM | PF000628 | PHD |
|  | SMART | SM00249 | PHD |
|  | ProSite | PS01359 | ZF_PHD_1 |
| IPR013083 Zinc finger, RING/FYVE/PHD-type |  | G3DSA:3,30,40,10 | No description |
| noIPR, unintegrated | Panther | PTHR23123 | PHD/F-box containing protein |
|  | TMHMM | Transmembrane_regions |  |

4.5. REF/ALY Polypeptides

The results of the InterPro scan of the polypeptide sequence as represented by SEQ ID NO: 498 are presented in Table C5.

TABLE C5

InterPro scan results (major accession numbers) of the polypeptide sequence as represented by SEQ ID NO: 498.
Table C5. Interpro scan.

| InterPro Accession number IPR000504 | Database | Accession number | Accession reference | Description: RNA recognition motif, RNP-1 Amino acid coordinates in SEQ ID NO: 498 |
|---|---|---|---|---|
| | PFAM | PF00076 | RRM_1 | [90-160] |
| | SMART | SM00360 | RRM | [89-161] |
| | PROFILE | PS50102 | RRM | [88-165] |

Alternatively to interpro database, conserved amino acid regions and domains in SEQ ID NO: 498 were identified by searching the Pfam database version Pfam 22.0 (July 2007, 9318 families) using an evalue cut-off of 1.0. Pfam database contained a large collection of protein families, each represented by multiple sequence alignments and hidden Markov models (HMMs).

The results of the Pfam search of the polypeptide sequence as represented by SEQ ID NO: 498 are presented in Table C6.

TABLE C6

Pfam Search.

| Pfam-A | Description | Entry type | Amino acid coordinates in SEQ ID NO: 498 Start | End | Bits score | E-value | Alignment mode |
|---|---|---|---|---|---|---|---|
| RRM_1 | RNA recognition motif. (a.k.a. RRM, RBD, or RNP domain) | Domain | 90 | 160 | 58.2 | 1.7e–15 | fs |
| GRP | Glycine rich protein family | Family | 153 | 216 | –38.9 | 0.8 | ls |

Example 5

Subcellular Localisation Prediction of the Polypeptide Sequences Useful in Performing the Methods of the Invention

5.1. Zinc Finger (Znf) Domain-Containing A20/AN1 Polypeptide

Experimental methods for protein localization range from immunolocalization to tagging of proteins using green fluorescent protein (GFP) or beta-glucuronidase (GUS). Such methods to identify subcellular compartmentalisation of Znf A20/AN1 polypeptides are well known in the art. For example, one Znf A20/AN1 polypeptide was found to be localized in the cytoplasm (Kanneganti & Gupta (2008) supra).

Computational prediction of protein localisation from sequence data was performed. Among algorithms well known to a person skilled in the art are available at the ExPASy Proteomics tools hosted by the Swiss Institute for Bioinformatics, for example, PSort, TargetP, ChloroP, LocTree, Predotar, LipoP, MITOPROT, PATS, PTS1, SignalP and others.

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

The results of the prediction show that SEQ ID NO: 213 is not targeted to the chloroplast (cTP), is not targeted to the mitochondria (mTP), and is not targeted to the secretory pathway (SP), as shown by the calculated probability values. The highest probability is obtained with "other", which means any other location than the three cited hereinabove. Thus, the cytoplasm and/or the nucleus are possible subcellular localisations for a polypeptide as represented by SEQ ID NO: 213.

TABLE D1

Output of the results for subcellular localisation of SEQ ID NO: 213 using TargetP

| Name | Length | cTP | mTP | SP | other | Loc | RC |
|---|---|---|---|---|---|---|---|
| Sequence | 160 | 0.278 | 0.014 | 0.002 | 0.826 | — | 3 |
| cutoff | | 0.000 | 0.000 | 0.000 | 0.000 | | |

5.2. PHD-zf Polypeptide

Experimental methods for protein localization range from immunolocalization to tagging of proteins using green fluorescent protein (GFP) or beta-glucuronidase (GUS). Such methods to identify subcellular compartmentalisation of GRF polypeptides are well known in the art.

A predicted nuclear localisation signal (NLS) was found by multiple sequence alignment, followed by eye inspection, in the polypeptide sequences of Table A4. An NLS is one or more short sequences of positively charged lysines or arginines.

Computational prediction of protein localisation from sequence data was performed. Among algorithms well known to a person skilled in the art are available at the ExPASy Proteomics tools hosted by the Swiss Institute for Bioinformatics, for example, PSort, TargetP, ChloroP, LocTree, Predotar, LipoP, MITOPROT, PATS, PTS1, SignalP, TMHMM, TMpred, and others.

A transmembrane domain usually denotes a single transmembrane alpha helix of a transmembrane protein. It is called "domain" because an alpha-helix in membrane can be folded independently on the rest of the protein. More broadly, a transmembrane domain is any three-dimensional protein structure which is thermodynamically stable in membrane. This may be a single alpha helix, a stable complex of several transmembrane alpha helices, a transmembrane beta barrel, a beta-helix of gramicidin A, or any other structure.

Transmembrane helices are usually about 20 amino acids in length, although they may be much longer or shorter. TMHMM2.0 is an algorithm that can predict transmembrane spanning helices in proteins. The algorithm is hosted on the server of Technical University of Denmark. Table D2 below shows the output of TMHMM2.0 using the polypeptide sequence information of SEQ ID NO: 348. Using this algorithm, at least one transmembrane domain is predicted. FIG. 12 is a graphical representation of the output as in Table D2.

TABLE D2

Output of TMHMM2.0 (and TMpred) using the polypeptide sequence information of SEQ ID NO: 348.

| Polypeptide ID | Algorithm used | Predicted AA coordinates |
|---|---|---|
| SEQ ID NO: 348 | TMHMM 2.0 | 91-111 |
| SEQ ID NO: 348 | TMPred | 94-111 |

Example 6

Assay Related to the Polypeptide Sequences Useful in Performing the Methods of the Invention 6.1. Zinc Finger (Znf) Domain-Containing A20/AN1 Polypeptide Znf A20/AN1 polypeptides useful in the methods of the present invention (at least in their native form) typically, but not necessarily, have transcriptional regulatory activity and capacity to interact with other proteins. DNA-binding activity and protein-protein interactions may readily be determined in vitro or in vivo using techniques well known in the art (for example in Current Protocols in Molecular Biology, Volumes 1 and 2, Ausubel et al. (1994), Current Protocols). For example, the A20 zinc finger domain and the AN1 zinc finger domain of Znf A20/AN1 polypeptides are capable of interacting with each other in vivo in yeast cells, using a yeast two-hybrid protein-protein interaction assay (Kanneganti & Gupta, supra). The experiments described in this publication are useful in characterizing Znf A20/AN1 polypeptides, and are well known in the art.

6.2. PHD-zf Polypeptide

PHD-zf polypeptides useful in the methods of the present invention (at least in their native form) typically, but not necessarily, have transcriptional regulatory activity and capacity to interact with other proteins. DNA-binding activity and protein-protein interactions may readily be determined in vitro or in vivo using techniques well known in the art (for example in Current Protocols in Molecular Biology, Volumes 1 and 2, Ausubel et al. (1994), Current Protocols). PHD-zf domains contain a C4HC3 zinc-finger-like motif found in nuclear proteins thought to be involved in chromatin-mediated transcriptional regulation, and more specifically bind DNA at a core hexamer motif of either GNGGTG or GTGGNG (Bastola, et al., 1998). The experiments described in this publication are useful in characterizing PHD-zf polypeptides, and are well known in the art.

Example 7

Cloning of the Nucleic Acid Sequence Used in the Methods of the Invention 7.1. TFL1-Like Polypeptides
7.1.1. pGOS2::ArathTFL1-Like 1

In the case of ArathTFL1-like_1, the nucleic acid sequence used in the methods of the invention was amplified by PCR using as template a custom-made *Arabidopsis* thaliana seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were (SEQ ID NO: 126; sense): 5'-ggggacaagtttgtacaaaaaagcaggcttaaaca atggccaggatttcctca-3' and SEQ ID NO: 127; reverse, complementary): 5'-ggggaccactttgtacaagaaagctgggtcattcaacggcgtctagc-3' which include the AttB sites for GATEWAY® recombination. The amplified PCR fragment was purified also using standard methods. The first step of the GATEWAY® procedure, the BP reaction, was then performed, during which the PCR fragment recombines in vivo with the pDONR201 plasmid to produce, according to the GATEWAY® terminology, an "entry clone", pArath_TFL1_like. Plasmid pDONR201 was purchased from Invitrogen, as part of the GATEWAY® technology.

The entry clone comprising SEQ ID NO: 1 was then used in an LR reaction with a destination vector used for *Oryza sativa* transformation. This vector contained as functional elements within the T-DNA borders: a plant selectable marker; a screenable marker expression cassette and a GATEWAY® cassette intended for LR in vivo recombination with the nucleic acid sequence of interest already cloned in the entry clone. A rice GOS2 promoter (SEQ ID NO: 128) for constitutive specific expression was located upstream of this GATEWAY® cassette.

After the LR recombination step, the resulting expression vector pGOS2::ArathTFL1-like_1 (FIG. 3) was transformed into *Agrobacterium* strain LBA4044 according to methods well known in the art.

7.1.2. pGOS2::P.trichocarpa_575797_BFT

In the case of Poptr_TFL1-like.sub.-1, the nucleic acid sequence used in the methods of the invention was amplified by PCR using as template a custom-made *Populus trichocarpa* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were (SEQ ID NO: 119; sense): 5'-ggggacaagtttgt acaaaaaagcaggcttaaacaatgt-caagggccatggaa-3' and SEQ ID NO: 120; reverse, complementary): 5'-ggggaccactttgtacaagaaagctggg-tatgaaggaaaacccacaacac-3' which include the AttB sites for GATEWAY® recombination. The amplified PCR fragment was purified also using standard methods. The first step of the GATEWAY® procedure, the BP reaction, was then performed, during which the PCR fragment recombines in vivo with the pDONR201 plasmid to produce, according to the GATEWAY® terminology, an "entry clone", pPoptr_TFL1-like_1. Plasmid pDONR201 was purchased from Invitrogen, as part of the GATEWAY® technology.

The entry clone comprising SEQ ID NO: 25 was then used in an LR reaction with a destination vector used for *Oryza*

*sativa* transformation. This vector contained as functional elements within the T-DNA borders: a plant selectable marker; a screenable marker expression cassette and a GATEWAY® cassette intended for LR in vivo recombination with the nucleic acid sequence of interest already cloned in the entry clone. A rice GOS2 promoter (SEQ ID NO: 128) for constitutive specific expression was located upstream of this GATEWAY® cassette.

After the LR recombination step, the resulting expression vector pGOS2::*P.trichocarpa*_575797_BFT was transformed into *Agrobacterium* strain LBA4044 according to methods well known in the art.

7.2. Ribose 5-Phosphate Isomerase (R5PI)

The nucleic acid sequence used in the methods of the invention was amplified by PCR using as template a custom-made *Arabidopsis thaliana* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were (SEQ ID NO: 209; sense): 5'-gggga-caagtttgtacaaaaaagcaggcttaaacaatgggttctgcattcgatc-3' and (SEQ ID NO: 210; reverse, complementary): 5'-ggggac-cactttgtacaagaa agctgggtaccctaatggttttcaaatgac-3', which include the AttB sites for GATEWAY® recombination. The amplified PCR fragment was purified also using standard methods. The first step of the GATEWAY® procedure, the BP reaction, was then performed, during which the PCR fragment recombined in vivo with the pDONR201 plasmid to produce, according to the GATEWAY® terminology, an "entry clone", p*A.thaliana*_AT1G71100.Plasmid pDONR201 was purchased from Invitrogen, as part of the GATEWAY® technology.

The entry clone comprising SEQ ID NO: 140 was then used in an LR reaction with a destination vector used for *Oryza sativa* transformation. This vector contained as functional elements within the T-DNA borders: a plant selectable marker; a screenable marker expression cassette; and a GATEWAY® cassette intended for LR in vivo recombination with the nucleic acid sequence of interest already cloned in the entry clone. A rice GOS2 promoter (SEQ ID NO: 211) for constitutive specific expression was located upstream of this GATEWAY® cassette.

After the LR recombination step, the resulting expression vector pGOS2::*A.thaliana*_AT1G71100 (FIG. 6) was transformed into *Agrobacterium* strain LBA4044 according to methods well known in the art.

7.3. Zinc Finger (Znf) Domain-Containing A20/AN1 Polypeptide

The *Arabidopsis thaliana* cDNA encoding the Znf A20/AN1 polypeptide sequence as represented by SEQ ID NO: 213 was amplified by PCR using as template an *Arabidopsis* cDNA bank synthesized from mRNA extracted from mixed plant tissues. The following primers, which include the AttB sites for GATEWAY® recombination, were used for PCR amplification: prm09483 (SEQ ID NO: 343, sense): 5'-ggg-gacaagtttgtacaaaaaagcaggc ttaaacaatggctcagagaacggaga-3' and prm09484(SEQ ID NO: 344, reverse, complementary): 5'-ggggaccactttgtacaagaaagctgggtaacggttgagatcgaattttt-3'. PCR was performed using Hifi Taq DNA polymerase in standard conditions. A PCR fragment of the expected length (including attB sites) was amplified and purified also using standard methods. The first step of the GATEWAY® procedure, the BP reaction, was then performed, during which the PCR fragment recombined in vivo with the pDONR201 plasmid to produce, according to the GATEWAY® terminology, an "entry clone". Plasmid pDONR201 was purchased from Invitrogen, as part of the GATEWAY® technology.

The *Medicago truncatula* cDNA encoding the Znf A20/AN1 polypeptide sequence as represented by SEQ ID NO: 215 was amplified by PCR using as template a *Medicago truncatula* cDNA bank synthesized from mRNA extracted from mixed plant tissues. The following primers, which include the AttB sites for GATEWAY® recombination, were used for PCR amplification: prm09485 (SEQ ID NO: 345, sense): 5'-ggggacaagtttgtacaaaaaagcag gcttaaacaatggctcaaa-gaacagaaaat-3' and prm09486 (SEQ ID NO: 346 reverse, complementary): 5'-ggggaccactttgtacaa-gaaagctgggtttgaattttgcttttcacac-3'. The same cloning procedure was then used as for SEQ ID NO: 212 hereinabove.

The entry clone comprising SEQ ID NO: 212 was subsequently used in an LR reaction with a destination vector used for *Oryza sativa* transformation. This vector contained as functional elements within the T-DNA borders: a plant selectable marker; a screenable marker expression cassette; and a GATEWAY® cassette intended for LR in vivo recombination with the nucleic acid sequence of interest already cloned in the entry clone. A rice GOS2 promoter (SEQ ID NO: 131) for constitutive expression was located upstream of this GATEWAY® cassette.

After the LR recombination step, the resulting expression vector pGOS2::ZnfA20/AN1 (FIG. 10) was transformed into *Agrobacterium* strain LBA4044 according to methods well known in the art.

The entry clone comprising SEQ ID NO: 214 was subsequently used in the same procedure as above, and also cloned downstream of a rice GOS2 promoter.

7.4. PHD-zf Polypeptide

The *Lycopersicon esculentum* nucleic acid sequence encoding a PHD-zf polypeptide sequence as represented by SEQ ID NO: 348 was amplified by PCR using as template a cDNA bank constructed using RNA from tomato plants at different developmental stages. The following primers, which include the AttB sites for GATEWAY® recombination, were used for PCR amplification: prm 09483 (SEQ ID NO: 495, sense): 5'-ggggacaagtttgtacaaaa aagcaggcttaaacaatggct-cagagaacggaga-3' and prm 02266 (SEQ ID NO: 496, reverse, complementary): 5'-ggggaccactttgtacaagaaagctggg-taacggttgagatcgaattttt-3'. PCR was performed using Hifi Taq DNA polymerase in standard conditions. A PCR fragment of the expected length (including attB sites) was amplified and purified also using standard methods. The first step of the GATEWAY® procedure, the BP reaction, was then performed, during which the PCR fragment recombined in vivo with the pDONR201 plasmid to produce, according to the GATEWAY® terminology, an "entry clone". Plasmid pDONR201 was purchased from Invitrogen, as part of the GATEWAY® technology.

The entry clone comprising SEQ ID NO: 347 was subsequently used in an LR reaction with a destination vector used for *Oryza sativa* transformation. This vector contained as functional elements within the T-DNA borders: a plant selectable marker; a screenable marker expression cassette; and a GATEWAY® cassette intended for LR in vivo recombination with the nucleic acid sequence of interest already cloned in the entry clone. A rice GOS2 promoter (SEQ ID NO: 494) for constitutive expression was located upstream of this GATEWAY® cassette.

After the LR recombination step, the resulting expression vector pGOS2::PHD-zf (FIG. 14) for constitutive expression, was transformed into *Agrobacterium* strain LBA4044 according to methods well known in the art.

7.5. REF/ALY Polypeptides

The nucleic acid sequence used in the methods of the invention was amplified by PCR using as template a custom-made *Arabidopsis thaliana* seedlings cDNA library (in pCMV Sport 6.0; Invitrogen, Paisley, UK). PCR was performed using Hifi Taq DNA polymerase in standard conditions, using 200 ng of template in a 50 ·mu·d PCR mix. The primers used were 5'-ggggacaagtttgtacaaaaaagcag-gcttaaacaatgtcgactggattagatatg-3' (SEQ ID NO: 545; sense, start codon in bold) and 5'-ggggaccactttgtacaa-gaaagctgggtgtcacg ttccttagtttgtc-3' (SEQ ID NO: 546; reverse, complementary), which include the AttB sites for GATEWAY® recombination. The amplified PCR fragment was purified also using standard methods. The first step of the GATEWAY® procedure, the BP reaction, was then performed, during which the PCR fragment recombined in vivo with the pDONR201 plasmid to produce, according to the GATEWAY® terminology, an "entry clone", pREF/ALY. Plasmid pDONR201 was purchased from Invitrogen, as part of the GATEWAY® technology.

The entry clone comprising SEQ ID NO: 497 was then used in an LR reaction with a destination vector used for *Oryza sativa* transformation. This vector contained as functional elements within the T-DNA borders: a plant selectable marker; a screenable marker expression cassette; and a GATEWAY® cassette intended for LR in vivo recombination with the nucleic acid sequence of interest already cloned in the entry clone. In one destination vector a rice GOS2 promoter (SEQ ID NO: 547) for constitutive specific expression was located upstream of this GATEWAY® cassette. In a second destination vector a rice HMGP promoter (SEQ ID NO: 52) was used to drive constitutive expression.

After the LR recombination step, the resulting expression vectors pGOS2::REF/ALY and pHMGP::REF/ALY (FIG. 17) was transformed into *Agrobacterium* strain LBA4044 according to methods well known in the art.

Example 8

Plant Transformation

Rice Transformation

The *Agrobacterium* containing the expression vector was used to transform *Oryza sativa* plants. Mature dry seeds of the rice japonica cultivar Nipponbare were dehusked. Sterilization was carried out by incubating for one minute in 70% ethanol, followed by 30 minutes in 0.2% $HgCl_2$, followed by a 6 times 15 minutes wash with sterile distilled water. The sterile seeds were then germinated on a medium containing 2,4-D (callus induction medium). After incubation in the dark for four weeks, embryogenic, scutellum-derived calli were excised and propagated on the same medium. After two weeks, the calli were multiplied or propagated by subculture on the same medium for another 2 weeks. Embryogenic callus pieces were sub-cultured on fresh medium 3 days before co-cultivation (to boost cell division activity).

*Agrobacterium* strain LBA4404 containing the expression vector was used for co-cultivation. *Agrobacterium* was inoculated on AB medium with the appropriate antibiotics and cultured for 3 days at 28° C. The bacteria were then collected and suspended in liquid co-cultivation medium to a density ($OD_{600}$) of about 1. The suspension was then transferred to a Petri dish and the calli immersed in the suspension for 15 minutes. The callus tissues were then blotted dry on a filter paper and transferred to solidified, co-cultivation medium and incubated for 3 days in the dark at 25° C. Co-cultivated calli were grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential was released and shoots developed in the next four to five weeks. Shoots were excised from the calli and incubated for 2 to 3 weeks on an auxin-containing medium from which they were transferred to soil. Hardened shoots were grown under high humidity and short days in a greenhouse.

Approximately 35 independent T0 rice transformants were generated for one construct. The primary transformants were transferred from a tissue culture chamber to a greenhouse. After a quantitative PCR analysis to verify copy number of the T-DNA insert, only single copy transgenic plants that exhibit tolerance to the selection agent were kept for harvest of T1 seed. Seeds were then harvested three to five months after transplanting. The method yielded single locus transformants at a rate of over 50% (Aldemita and Hodges 1996, Chan et al. 1993, Hiei et al. 1994).

Corn Transformation

Transformation of maize (*Zea mays*) is performed with a modification of the method described by Ishida et al. (1996) Nature Biotech 14(6): 745-50. Transformation is genotype-dependent in corn and only specific genotypes are amenable to transformation and regeneration. The inbred line A188 (University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with *Agrobacterium tumefaciens* containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation

Transformation of wheat is performed with the method described by Ishida et al. (1996) Nature Biotech 14(6): 745-50. The cultivar Bobwhite (available from CIMMYT, Mexico) is commonly used in transformation. Immature embryos are co-cultivated with *Agrobacterium tumefaciens* containing the expression vector, and transgenic plants are recovered through organogenesis. After incubation with *Agrobacterium*, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation

Soybean is transformed according to a modification of the method described in the Texas A&M U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with *Agrobacterium tumefaciens* containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with *Agrobacterium* (containing the expression vector) by dipping the cut end of the petiole explant into the bacterial suspension. The explants are then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown D C W and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659). Petiole explants are cocultivated with an overnight culture of *Agrobacterium tumefaciens* C58C1 pMP90 (McKersie et al., 1999 Plant Physiol 119: 839-847) or LBA4404 containing the expression vector. The explants are cocultivated for 3 d in the dark on SH induction medium containing 288 mg/L Pro, 53 mg/L thioproline, 4.35 g/L K2SO4, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Sk-oog medium. Rooted seedlings were transplanted into pots and grown in a greenhouse. T1 seeds are produced from plants that exhibit tolerance to the selection agent and that contain a single copy of the T-DNA insert.

Cotton Transformation

Cotton is transformed using *Agrobacterium tumefaciens* according to the method described in U.S. Pat. No. 5,159,135. Cotton seeds are surface sterilised in 3% sodium hypochlorite solution during 20 minutes and washed in distilled water with 500 μg/ml cefotaxime. The seeds are then transferred to SH-medium with 50 μg/ml benomyl for germination. Hypocotyls of 4 to 6 days old seedlings are removed, cut into 0.5 cm pieces and are placed on 0.8% agar. An *Agrobacterium* suspension (approx. 108 cells per ml, diluted from an overnight culture transformed with the gene of interest and suitable selection markers) is used for inoculation of the hypocotyl explants. After 3 days at room temperature and lighting, the tissues are transferred to a solid medium (1.6 g/l Gelrite) with Murashige and Skoog salts with B5 vitamins (Gamborg et al., Exp. Cell Res. 50:151-158 (1968)), 0.1 mg/l 2,4-D, 0.1 mg/l 6-furfurylaminopurine and 750 μg/ml MgCL2, and with 50 to 100 μg/ml cefotaxime and 400-500 μg/ml carbenicillin to kill residual bacteria. Individual cell lines are isolated after two to three months (with subcultures every four to six weeks) and are further cultivated on selective medium for tissue amplification (30° C., 16 hr photoperiod). Transformed tissues are subsequently further cultivated on non-selective medium during 2 to 3 months to give rise to somatic embryos. Healthy looking embryos of at least 4 mm length are transferred to tubes with SH medium in fine vermiculite, supplemented with 0.1 mg/l indole acetic acid, 6 furfurylaminopurine and gibberellic acid. The embryos are cultivated at 30° C. with a photoperiod of 16 hrs, and plantlets at the 2 to 3 leaf stage are transferred to pots with vermiculite and nutrients. The plants are hardened and subsequently moved to the greenhouse for further cultivation.

Example 9

Phenotypic Evaluation Procedure 9.1 Evaluation Setup

Approximately 35 independent T0 rice transformants were generated. The primary transformants were transferred from a tissue culture chamber to a greenhouse for growing and harvest of T1 seed. Events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the corresponding nullizygotes were grown side-by-side at random positions. Greenhouse conditions were of shorts days (12 hours light), 28° C. in the light and 22° C. in the dark, and a relative humidity of 70%. Plants grown under non-stress conditions are supplied with water at regular intervals to ensure that water and nutrients are not limiting to satisfy plant needs to complete growth and development.

Four T1 events were further evaluated in the T2 generation following the same evaluation procedure as for the T1 generation but with more individuals per event. From the stage of sowing until the stage of maturity the plants were passed several times through a digital imaging cabinet. At each time point digital images (2048×1536 pixels, 16 million colours) were taken of each plant from at least 6 different angles.

Drought Screen

Plants from T2 seeds were grown in potting soil under normal conditions until they approached the heading stage. They were then transferred to a "dry" section where irrigation is withheld. Humidity probes were inserted in randomly chosen pots to monitor the soil water content (SWC). When SWC goes below certain thresholds, the plants were automatically re-watered continuously until a normal level is reached again. The plants were then re-transferred again to normal conditions. The rest of the cultivation (plant maturation, seed harvest) was the same as for plants not grown under abiotic stress conditions. Growth and yield parameters were recorded as detailed for growth under normal conditions.

Nitrogen Use Efficiency Screen

Rice plants from T2 seeds are grown in potting soil under normal conditions except for the nutrient solution. The pots are watered from transplantation to maturation with a specific nutrient solution containing reduced N nitrogen (N) content, usually between 7 to 8 times less. The rest of the cultivation (plant maturation, seed harvest) is the same as for plants not grown under abiotic stress. Growth and yield parameters are recorded as detailed for growth under normal conditions.

Salt Stress Screen

Plants are grown on a substrate made of coco fibers and argex (3 to 1 ratio). A normal nutrient solution is used during the first two weeks after transplanting the plantlets in the greenhouse. After the first two weeks, 25 mM of salt (NaCl) is added to the nutrient solution, until the plants are harvested. Seed-related parameters are then measured.

9.2 Statistical Analysis: F Test

A two factor ANOVA (analysis of variants) was used as a statistical model for the overall evaluation of plant phenotypic characteristics. An F test was carried out on all the parameters measured of all the plants of all the events transformed with the gene of the present invention. The F test was carried out to check for an effect of the gene over all the transformation events and to verify for an overall effect of the gene, also known as a global gene effect. The threshold for significance for a true global gene effect was set at a 5% probability level for the F test. A significant F test value points to a gene effect, meaning that it is not only the mere presence or position of the gene that is causing the differences in phenotype.

9.3 Parameters Measured

Biomass-Related Parameter Measurement

From the stage of sowing until the stage of maturity the plants were passed several times through a digital imaging cabinet. At each time point digital images (2048×1536 pixels, 16 million colours) were taken of each plant from at least 6 different angles.

The plant aboveground area (or leafy biomass) was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The above ground area is the area measured at the time point at which the plant had reached its maximal leafy biomass. The early vigour is the plant (seedling) aboveground area three weeks post-germination. Increase in root biomass is expressed as an increase in total root biomass (measured as maximum biomass of roots observed during the lifespan of a plant); or as an increase in the root/shoot index (measured as the ratio between root mass and shoot mass in the period of active growth of root and shoot).

Early vigour was determined by counting the total number of pixels from aboveground plant parts discriminated from the background. This value was averaged for the pictures taken on the same time point from different angles and was converted to a physical surface value expressed in square mm by calibration. The results described below are for plants three weeks post-germination.

Seed-Related Parameter Measurements

The mature primary panicles were harvested, counted, bagged, barcode-labelled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed yield was measured by weighing all filled husks harvested from a plant. Total seed number per plant was measured by counting the number of husks harvested from a plant. Thousand Kernel Weight (TKW) is extrapolated from the number of filled seeds counted and their total weight. The Harvest Index (HI) in the present invention is defined as the ratio between the total seed yield and the above ground area ($mm^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Example 10

Results of the Phenotypic Evaluation of the Transgenic Plants 10.1. TFL1-Like Polypeptides
10.1.1 Plant Performance Under Non-Stress Conditions
10.1.1.1. pGOS2::ArathTFL1-like 1

The results of the evaluation of transgenic rice plants expressing a TFL1-like nucleic comprising the longest ORF (Open Reading Frame) of SEQ ID NO: 1 under the control of the GOS2 promoter in non-stress conditions are presented below. An increase of at least 5% was observed for Total seed weight per plant the number of filled seeds per panicle, the (Seed) filled rate, number of flowers per panicle and the harvest index (Table E1).

TABLE E1

| Yield-related trait | % Increase in the transgenic plants compared to the control nullizygote plant |
| --- | --- |
| Total seed weight per plant | 9.6 |
| Number of filled seeds per panicle | 11.7 |
| (Seed) filled rate | 6.0 |
| Number of flowers per panicle | 14.9 |
| Harvest index | 11.1 |

10.1.1.2. pGOS2:: *P.trichocarpa* 575797 BFT

The results of the evaluation of T1 (first generation) transgenic rice plants expressing a TFL1-like nucleic comprising the longest ORF (Open Reading Frame) of SEQ ID NO: 25 under the control of the GOS2 promoter in non-stress conditions are presented below (Table E2). An increase of at least 5% was observed for root biomass (RootMax), total seed weight (totalwgseeds), the number of filled seeds per panicle (nrfilledseed), the number seeds per plant (nrtotalseed), the (Seed) filled rate (fillrate), number of flowers per panicle (flowerperpan) and the harvest index (harvestindex)(Table E1); the intensity of the green colour in the leaves (GNbfFlow), proportion of thick roots (RootThickMax) and gravity center (GravityYMax).

The green colour in the leaves (GNbfFlow) refers to the greenness of a plant before flowering. It is expressed as a proportion (expressed as %) of green and dark green pixels in the images of plants. Measurement was done before flowering. The intensity of green colour is typically used as a measure for photosynthetic capacity of a plant.

RootThickMax is a measure of the proportion of thick roots compared to the thin roots in the root system of a plant. The proportion of thick roots is typically used as a measure for the biomass of roots above a given thickness threshold. It is typically used as a measure for estimating soil penetration, plant stability, nutrient uptake, water uptake, and tolerance to biotic and abiotic stresses.

GravityYMax is a measure of the gravity centre of the leafy biomass of a plant. It is typically used as a measure for estimating the plant height.

TABLE E2

| Yield-related trait | % Increase in the transgenic plants compared to the control nullizygote plant |
|---|---|
| totalwgseeds | 34.6 |
| nrtotalseed | 9.3 |
| fillrate | 19.0 |
| harvestindex | 32.8 |
| GNbfFlow | 8.9 |
| nrfilledseed | 30.0 |
| flowerperpan | 17.2 |
| GravityYMax | 5.0 |
| RootMax | 6.0 |
| RootThickMax | 10.6 |

10.1.2 Plant Performance Under Stress Conditions
10.1.2.1 pGOS2:: P.trichocarpa 575797 BFT The results of the evaluation of T1 (first generation) transgenic rice plants expressing a TFL1-like nucleic acid comprising the longest ORF (Open Reading Frame) of SEQ ID NO: 25 under the control of the GOS2 promoter in the Drought screen of above are presented below (Table E3). An increase of at least 5% was observed for the time to flower (TimetoFlower), Root to Shoot index (RootShInd), root biomass (RootMax), total seed weight (totalwgseeds), the number of filled seeds per panicle (nrfilledseed), the number seeds per plant (nrtotalseed), the (Seed) filled rate (fillrate), number of flowers per panicle (flowerperpan) and the harvest index (harvestindex) (Table E1); the intensity of the green colour in the leaves (GNbfFlow), proportion of thick roots (RootThickMax) and gravity center (GravityYMax). An increase of at least 3% was observed for the thousand kernel weight (TKW).

TABLE E3

| Yield-related trait | % Increase in the transgenic plants compared to the control nullizygote plant |
|---|---|
| TimetoFlower | 10.5 |
| RootShInd | 11.2 |
| totalwgseeds | 98.9 |
| Fillrate | 109.0 |
| harvestindex | 101.7 |

TABLE E3-continued

| Yield-related trait | % Increase in the transgenic plants compared to the control nullizygote plant |
|---|---|
| TKW | 7.9 |
| nrfilledseed | 87.2 |
| flowerperpan | 38.8 |
| GravityYMax | 11.0 |
| AreaCycl | 13.9 |

Time to flower is a measure of the time elapse between sowing and the emergence of the first panicle of the plants. It is typically used as a measure for estimating the flowering time of a plant.

Root to Shoot index (RootShInd) is a the ratio between root mass and shoot mass in the period of active growth of root and shoot. It is typically a measure of carbon partitioning between the aboveground and belowground biomass.

AreaCycl is a measure of the time elapse between sowing and the emergence of the first panicle of a plant, that is, the period of accruing biomass of a plant. It is calculated as the time (in days) needed between sowing and the day the plant reaches 90% of its final biomass. It is typically used as a measure for estimating the growth rate of a plant.

10.2. Ribose 5-Phosphate Isomerase (R5PI)

The results of the evaluation of transgenic rice plants expressing the R5PI nucleic acid corresponding to the coding sequence of A.thaliana_AT1G71100 under Nitrogen deficiency conditions according to the Nitrogen use efficiency screen are presented below (Table E4). An increase of at least 5% was observed for root biomass, total weight of seeds per plant, The number of filled seeds per plant, the number of flowers per panicle and the total number of seeds per plant.

The results of the evaluation of transgenic rice plants expressing the R5PI nucleic acid corresponding to the coding sequence of A.thaliana_AT1G71100 under non-stress conditions are presented hereunder (Table E5). An increase was observed for early vigour, number of primary (first) panicles, total number of seeds per plant.

TABLE E4

Evaluation of yield-related traits under nitrogen deficiency (Nitrogen use efficiency screen).

| Yield-Trait | % increase in the transgenics versus the control plants |
|---|---|
| Root biomass | 3.9 |
| Total weight of seeds per plant | 17.9 |
| Number of filled seeds per plant | 16.2 |
| Number of flowers per panicle | 9.0 |
| Total number of seeds per plant | 10.3 |

TABLE E5

Evaluation of yield-related traits under non-stress conditions

| Yield Trait | % increase in the transgenics versus the control plants |
|---|---|
| Early vigour | 19.5 |
| Number of primary (first) panicles | 7.5 |
| Total number of seeds per plant | 8.8 |

10.3. Zinc Finger (Znf) Domain-Containing A20/AN1 Polypeptide

The results of the evaluation of transgenic rice plants expressing the nucleic acid sequence encoding a Znf A20/

AN1 polypeptide as represented by SEQ ID NO: 213, under the control of the GOS2 promoter for constitutive expression, are presented below.

There was a significant increase in the early vigor, in the aboveground biomass, in the total seed yield per plant, in the number of filled seeds, in the seed filling rate, and in the harvest index, of the transgenic plants compared to corresponding nullizygotes (controls), as shown in Table E6.

TABLE E6

Results of the evaluation of transgenic rice plants expressing the nucleic acid sequence encoding a Znf A20/AN1 polypeptide as represented by SEQ ID NO: 213, under the control of the GOS2 promoter for constitutive expression.

| Trait | Overall average % increase in 8 events in the T1 generation | Overall average % increase in 4 events in the T2 generation |
|---|---|---|
| Aboveground biomass | 9% | 5% |
| Early vigor | 11% | 10% |
| Total seed yield per plant | 30% | 16% |
| Total number of filled seeds | 31% | 16% |
| Seed filling rate | 17% | 8% |
| Harvest index | 21% | 11% |

The results of the evaluation of transgenic rice plants expressing the nucleic acid sequence encoding a Znf A20/AN1 polypeptide as represented by SEQ ID NO: 215, under the control of the GOS2 promoter for constitutive expression, are presented below.

There was a significant increase in the total seed yield per plant, in the number of filled seeds, in the seed filling rate, and in the harvest index, of the transgenic plants compared to corresponding nullizygotes (controls), as shown in Table E7.

TABLE E7

Results of the evaluation of transgenic rice plants expressing the nucleic acid sequence encoding a Znf A20/AN1 polypeptide as represented by SEQ ID NO: 215, under the control of the GOS2 promoter for constitutive expression.

| Trait | Overall average % increase in 8 events in the T1 generation |
|---|---|
| Total seed yield per plant | 19% |
| Total number of filled seeds | 18% |
| Seed filling rate | 19% |
| Harvest index | 20% |

10.4. PHD-zf Polypeptide

The results of the evaluation of T1 generation transgenic rice plants expressing the nucleic acid sequence encoding a PHD-zf polypeptide as represented by SEQ ID NO: 348, under the control of a constitutive promoter, and grown under normal growth conditions, are presented below.

There was a significant increase in plant height, in the seed fill rate, in the number of flowers per panicles, and in Thousand Kernel Weight (TKW), of the transgenic plants compared to corresponding nullizygotes (controls), as shown in Table E8.

TABLE E8

Results of the evaluation of T1 generation transgenic rice plants expressing the nucleic acid sequence encoding a PHD-zf polypeptide as represented by SEQ ID NO: 348, under the control of a promoter for constitutive expression.

| Trait | Overall average % increase in 6 events in the T1 generation |
|---|---|
| Plant height | 4% |
| Seed fill rate | 10% |
| Flowers per panicle | 10% |
| Thousand Kernel Weight | 2% |

10.5. REF/ALY Polypeptides

The results of the evaluation of the progeny of the rice plants transformed with the pGOS2::REF/ALY vector under non-stress conditions are presented below. An increase of at least 5% was observed for total seed yield (totalwgseeds or total weight of seeds), number of filled seeds (nrfilledseed), seed filling rate (fillrate), number of flowers per panicle (flowerperpan) and harvest index (harvestindex).

| Parameter | % increase in the transgenic compared to the control plant |
|---|---|
| totalwgseeds | 20 |
| nrfilledseed | 19 |
| fillrate | 11 |
| flowerperpan | 11 |
| harvestindex | 17 |

The results of the evaluation of the progeny of the rice plants transformed with the pHMGP::REF/ALY vector under non-stress conditions are presented below. An increase of at least 5% was observed for early vigour (EmerVigor), total seed yield (totalwgseeds or total weight of seeds) and number of filled seeds (nrfilledseed).

| Parameter | % Ov. |
|---|---|
| EmerVigor | 21 |
| totalwgseeds | 11 |
| nrfilledseed | 12 |

SEQUENCE LISTING (548 sequences)

SEQ ID NO: 1 - DNA, 564 bp, Arabidopsis thaliana
gtacaaaaaagcaggcttaaacaatggccaggatttcctcagacccgcttatggttgggagagtgatcggagacgttgtggacaattgtttgcaggcagtgaaaatgacggtgacctataattctgacaagcaagtctacaatggccatgaacttttcccttctgtagttacatacaaacctaaggttgaagttcatgggggtgacatgagatcattcttcactttggttatgactgatcctgatgttcctggacctagtgatccttatctgagagagcacttgcactggattgttaccgatatcccggggacgactgatgtatcatttggtaaagagataatcgggtacgagatgcctcggccaaacatagggatccaccgctttgtgtatttgttgttcaagcagacccgtagaggaagtgtggtgtctgtgccatcttacagagaccaattcaacactcgagagttcgctcatgagaacgatcttggcctccccgtcgcggctgttttcttcaactgccagcgtgagaccgccgctagacgccgttgaatgacccagcttt

SEQ ID NO: 2 - protein, 175 aa, Arabidopsis thaliana
MARISSDPLMVGRVIGDVVDNCLQAVKMTVTYNSDKQVYNGHELFPSVVTYKPKVEVHGGDMRSFFTLVMTDPDVPGPSDPYLREHLHWIVTDIPGTTDVSFGKEIIGYEMPRPNIGIHRFVYLLFKQTRRGSVVSVPSYRDQFNTREFAHENDLGLPVAAVFFNCQRETAARRR

SEQ ID NO: 3 - DNA, 571 bp, Oryza sativa
gtacaaaaaagcaggcttaaacaatgtctaggtctgtggagcctcttgttgtagggcacgtgattggggaagttcttgatacctttaacccatgcatgaagatgatagtgacctataactccaacaagcttgtatttaatggtcatgagctctacccatcagcagttgtgtctaaaccaagagttgaggtccaagggggtgacctgcgatctttcttcacattggttatgacagacccagatgtgccaggaccaagtgatccttatctaagggagcaccttcattggattgttactgatatacctgggacaacggatgcttcttttggacgcgaggtcataagctatgagagtccaaagccgaacattggcatccataggttcatttttgtgctcttcaagcagaagcgcaggcaaactgtaattgtgccatccttcagggaccatttcaacacccgccggttcgccgaggagaatgatcttggccttcctgtggctgctgtctacttcaatgcccagagagagactgcagccaggaggcgctgagaaatgcagctccaatacccagcttt

SEQ ID NO: 4 - protein, 173 aa, Oryza sativa
MSRSVEPLVVGHVIGEVLDTFNPCMKMIVTYNSNKLVFNGHELYPSAVVSKPRVEVQGGDLRSFFTLVMTDPDVPGPSDPYLREHLHWIVTDIPGTTDASFGREVISYESPKPNIGIHRFIFVLFKQKRRQTVIVPSFRDHFNTRRFAEENDLGLPVAAVYFNAQRETAARRR

SEQ ID NO: 5 - DNA, 907 bp, Oryza sativa
aataagcaaccaagggcacattgaagtgcactaggttttgtcatttacaactagccagagcactaatttcggaaaatataattacctgtccctccaaggctccaaccatgtctaggtctgtggagcctcttgttgttgggcgggtgatcggagaagttattgattcattcaacccatgtacgaagatgatagtaacctacaattcaaacaagcttgtctttaatggccatgagttctacccatcagcagttgtatctaaaccaagagtcgaggtccaagggggtgatatgcgttctttcttcacattggttatgacagacccagatgtgccaggaccaagtgatccatatctaagggaacacctacattggattgtaactgatatacctggaacaacggatgcctcttttggacgggaaatcataagctatgagagcccaaagcccagcattggtatccacaggttcgtttttgtgctcttcaagcagaagcgtaggcaggctgtagttgtgccatcctctagggatcatttcaatacacgccagtttgctgaggagaacgaacttggccttcctgtcgctgctgtctacttcaatgctcagagagagactgctgccaggagacgctaaaaaattccagctgtcattatccccgctgtgataaataaaaaccatccaatagtttctcctgtcgtctacattatctgccacatcactagattgtggatcaaggcttcatcattacgtcatttgcctcaagaaaatctacaataaaccaaatgcatttgacagattgtatcagtgtcagattgtttcccgtatcaaaaattaagtaatggattgtttttgtaagaagattgagagtcatgataaataccagtgcattcgcatgcaaatattagcaatct

SEQ ID NO: 6 - protein, 173 aa, Oryza sativa
MSRSVEPLVVGRVIGEVIDSFNPCTKMIVTYNSNKLVFNGHEFYPSAVVSKPRVEVQGGDMRSFFTLVMTDPDVPGPSDPYLREHLHWIVTDIPGTTDASFGREIISYESPKPSIGIHRFVFVLFKQKRRQAVVVPSSRDHFNTRQFAEENELGLPVAAVYFNAQRETAARRR

SEQ ID NO: 7 - DNA, 797 bp, Zea mays
gcttgctctgttcagtcagagcgagcgattcacatgtgaaacataagtacctgtccctccaaccatgtccaggtctgtggagcctctcatagtcgggcgggtgatcggagaagtcctcgactccttcaacccgtgtgtgaagatgatagtgacctacaactccaacaaactcgtgtttaatggccatgagatctacccatcagctgttgtgtccaaaccaagggtggaggttcaagggggcgatttgcggtctttcttcacattggttatgacagacccagatgttccaggaccaagtgatccatacctaagggagcaccttcattggatcgtgactgatatacctgggacaacagatgcctccttcgggcgacagatcataagctacgagagcccaagacctagcattggtatccacaggttcatttttgtgctcttcaagcagcagggtaggcaaaatgtaactgtgccatccttcagagatcatttcaacacccggcagttcgctgaggaaaatgaccttggcctccctgtagctgccgtctacttcaatgcacagagagaaactgctgctaggagacgctgaaaatcccagctcttattgcctacctgacgataataagggccttctgatcttctttctaggaagtcgatgaacttattctacattaaattctcctgagcactaccttataaataaaccagatgtattttgcggattgtgttagtactagaatgttttgtaagtaggaagaatgagaactatgaatgatccatgcttgtggtaaaaaaaaaaa

SEQ ID NO: 8 - protein, 173 aa, Zea mays
MSRSVEPLIVGRVIGEVLDSFNPCVKMIVTYNSNKLVFNGHEIYPSAVVSKPRVEVQGGDLRSFFTLVMTDPDVPGPSDPYLREHLHWIVTDIPGTTDASFGRQIISYESPRPSIGIHRFIFVLFKQQGRQNVTVPSFRDHFNTRQFAEENDLGLPVAAVYFNAQRETAARRR

SEQ ID NO: 9 - DNA, 831 bp, Zea mays
ttttttttttttttggctttcagtgatagatgtcttacacatcaaattttaccacaagcattgaccatttgtaattctcattcttgccacgtacaaagcattctaatactaatacaatcagcaaaacgcatctggtttatttatacggtagggctcaggagaatttaatgtagaataagttcattggcttcctagaaagaagatcagaaggcctttattatcatcaggtggacaataagagctggaattttcaacgtctcctagctgcagtttctctctgtgcattgaagtagacagcagctactgggaggccaaggtcattttcctcagcaaactgccgggtgttgaaatgatctctgaaggatggcacggttacagtttgcctacccttctgcttgaagagcacaaaaatgaacctgtggataccgatgttaggtcttgggctctcatagcttatgacctctcgcccaaaggaggcatctgttgtcccaggtatatcagtcacgatccaatgaaggtgctcccttagatatggatcacttggtcctggaacatctgggtctgtcataaccaatgtgaagaaagaccgcaaatcacccccttgaacctctaccctaggtttagatacaattgctgatgggtagatctcatggccattgaatacaagtttgtttgagttgtaggttactatcatcttgacacatgggttaaaggagtcgagaacttctccaatcacccgcccgactatgagaggctccacagacctagacatggttggtgtgacaggtatttgaattttgcacaagaaatgctctgactgaatggagcaag

SEQ ID NO: 10 - protein, 173 aa, Zea mays
MSRSVEPLIVGRVIGEVLDSFNPCVKMIVTYNSNKLVFNGHEIYPSAIVSKPRVEVQGGDLRSFFTLVMTDPDVPGPSDPYLREHLHWIVTDIPGTTDASFGREVISYESPRPNIGIHRFIFVLFKQKGRQTVTVPSFRDHFNTRQFAEENDLGLPVAAVYFNAQRETAARRR

SEQ ID NO: 11 - DNA, 887 bp, Zea mays
ctctcatatatattatcagagcttagccatgtctagagcgttggaacctctggtcgtcggcaaggtgatcggggaggtcatcgacaacttcaaccccacggtgaagatgacggttacctacggatccaacaagcaggtgttcaacggccatgagttctttccgtctgcggttctgtccaagccgcgcgtggaggttcagggcgacgacatgaggtccttcttcacgctggtcatgactgacccagatgtgccagggcctagtgatccatacctgagagagcacatccattggatcgtcaccgacattcctggaacaactgatgcttctttcggaagggagttggtgatgtacgagagcccgaagccgtacatcggcatccacaggttcgtcttcgtgctgttcaagcagagcagccggcagtcggcgcgcccgccctcgtccggcggcggcagggactacttcaacacccgccgctttgccgccgacaacaatcttggcctcccagttgccgcggtctacttcaacgcgcagcgggagactgccgcgcgccgccgctgatcgatcatcaccgctacctcttcccatgcatctcctttctcatcgcgtgcatggcgcatgcaaaatttatcgatctatagctactatatatgtggcctttattactatttcctacagtatgtggctatcgtcgtcaaataagagcttatgacacctttcagcgagagctagctagctgacctgtctcgatcgatctgctagcagtctctctgttcttcgttttttcggtcaataatcaattagaagctagcctctctagctgtgcatgaatgagcactcatgtatatgtaaagatgcaactcgtgtggcactgtgtgtgtgtgtgacc

SEQ ID NO: 12 - protein, 176 aa, Zea mays
MSRALEPLVVGKVIGEVIDNFNPTVKMTVTYGSNKQVFNGHEFFPSAVLSKPRVEVQGDDMRSFFTLVMTDPDVPGPSDPYLREHIHWIVTDIPGTTDASFGRELVMYESPKPYIGIHRFVFVLFKQSSRQSARPPSSGGGRDYFNTRRFAADNNLGLPVAAVYFNAQRETAARRR

SEQ ID NO: 13 - DNA, 765 bp, Glycine max
attcccgggtcgacattttcagcccaagtgtaaaaatgaatgtgacatattccaccaagcaagttgccaatggtcatgagttaatgccttctactattatggccaagccacgcgttgagattggtggtgatgacatgaagactgcttatacctctgtcatgactgacccagatgctccaagtcctagtgacccatgtctaagggaacatctccactggatggttacagatatccctggcaccacagatgtctcttttggaaaagagattgtaggctatgagagtccaaagccagtaataggaatccacaggtatgtgttcatcttgttcaagcagagaggaagacaaacagtgaggcctccatcttcaagagaccacttcaacacaaggaggttctcagaagagaatggccttggcctaccagttgctgcagtttacttcaatgctcaaagagagactgctgcaagaaggaggtgattcctgaagaagatgaagaagaaaaggttgcagcagtaaataaaattaactttattttaaccttaattgtctcataatgagatttgtttcctttggttttcttagggtttggcatggttgaacaataaggataagtgtgtttgattaaatctcttcctctcttgagtttttcctttggaggccacaagggaaattgtgaggtagatggtgttcaaaaggtagtagatattcttgatgtaccttgtacttctagctattataggttattgggaagttgtggaccaaacta

SEQ ID NO: 14 - protein, 157 aa, Glycine max
SRVDIFSPSVKMNVTYSTKQVANGHELMPSTIMAKPRVEIGGDDMKTAYTSVMTDPDAPSPSDPCLREHLHWMVTDIPGTTDVSFGKEIVGYESPKPVIGIHRYVFILFKQRGRQTVRPPSSRDHFNTRRFSEENGLGLPVAAVYFNAQRETAARRR

SEQ ID NO: 15 - DNA, 635 bp, Populus trichocarpa
tcccgttttcgtttccttaaccactacaaaatgtcaagggccatggaaccactgactgtcgggagagttgtgggagatgtggtggatatattcactcctagtgtgagaatgactgttacttataactccaacaaacaagttgctaatggctatgaattcatgccttctgtcattgcttataaacctagagttgagattggtggtgaggacatgaggactgcatatacactaatcatgacagaccctgatgctccaagccccagtgatccttacctaagagaacatctccactggatggtcactgacattcctggcacaactgatgtttcctttggaagggaaattgtgagctatgagactccaaagcccgtggttggtatccatagatatgtgttcatcttatttaaacagagaggaaggcaaactgtgagggcgccaccagcttcaagagactgtttcaacactagaatgttcgcaggagaaaatggattgggcctgccagtggctgcagtgtactttaatgcacagagagaaactgctgcgaggagaaggtgatgattaagagagtgttgtgggttttccttcatggacaaaataaagggtttattgtttcctggttttagggttttggattg

SEQ ID NO: 16 - protein, 174 aa, Populus trichocarpa
MSRAMEPLTVGRVVGDVVDIFTPSVRMTVTYNSNKQVANGYEFMPSVIAYKPRVEIGGEDMRTAYTLIMTDPDAPSPSDPYLREHLHWMVTDIPGTTDVSFGREIVSYETPKPVVGIHRYVFILFKQRGRQTVRAPPASRDCFNTRMFAGENGLGLPVAAVYFNAQRETAARRR

SEQ ID NO: 17 - DNA, 632 bp, Populus trichocarpa
tagctatatatatatatatatatacttgttatggcaaatctgtcggatcctcttgtggttgggagagtgattggagatgtaattgattatttcactccaaatgtgaaaatgactgtcacttataactccaacaagcaggtttataatggccatgagcttttcccatctgctgtcactcataaacctaaagttgaggtccatggtggtgatatgagatcttttttcaccctgatcatgacagacccagatgttccaggacctagtgatccatacctgagggagcacctacactggatagtaactgatatcccaggcaccacagatgccacattcggaagggaagtggtgaactatgagatgccaaggcctaacatcgggatccacaggtttgtttaccttcttttcaggcagaaaggaagacaaacagtgagcacaccatcctcaagggacaaatttaacacgaggaaatttgctgaagaaaatgagcttgacctgccggtagcagctgtcttcttcaatgctcaaagggaaacagctgcaaggagacgttgagatctaaagggtacttccaagaagaagattcaataataaccatgcaatattgtcatgccctactattgtacttcatgcag

SEQ ID NO: 18 - protein, 173 aa, Populus trichocarpa
MANLSDPLVVGRVIGDVIDYFTPNVKMTVTYNSNKQVYNGHELFPSAVTHKPKVEVHGGDMRSFFTLIMTDPDVPGPSDPYLREHLHWIVTDIPGTTDATFGREVVNYEMPRPNIGIHRFVYLLFRQKGRQTVSTPSSRDKFNTRKFAEENELDLPVAAVFFNAQRETAARRR

SEQ ID NO: 19 - DNA, 635 bp, Populus trichocarpa
ttctatagtatacaaatatttatagatatcatggcaaagatgtcagagcctcttgtggttgggagagtgattggagatgttatcgatcatttcactgcaaatgtgaaaatgacagtgacttatcagtccaacaggaagcaggtttttaatggccatgagctattcccatctgcggtaactcataaacctaaagttgaggttcatggaggtgatatgagatcctttttcaccctggtcatgacagaccctgatgttcctggtcctagtgatccatacctcagggagcacctacactggatagtaactgacatcccaggcaccacagatgccacatttggaagggaagtgatgaactatgagatgccaaggcctaacatagggatccacaggtttgttttcctacttttcaagcagaagggaaggcaaacagtgaccactccagcttcaagggacaaatttaacaccaggaaattcgctgaagaaaatgagcttggcctgcctgtagccgctgtcttcttcaatgcccaaagggaaacagcggcgaggaaacgttgaggagaagataatacaggaatcagaatgaataatgaccaatgccagccagcatcatgccctactattgtactatcaaactg

SEQ ID NO: 20 - protein, 174 aa, Populus trichocarpa
MAKMSEPLVVGRVIGDVIDHFTANVKMTVTYQSNRKQVFNGHELFPSAVTHKPKVEVHGGDMRSFFTLVMTDPDVPGPSDPYLREHLHWIVTDIPGTTDATFGREVMNYEMPRPNIGIHRFVFLLFKQKGRQTVTTPASRDKFNTRKFAEENELGLPVAAVFFNAQRETAARKR

SEQ ID NO: 21 - DNA, 597 bp, Triticum aestivum
  misc_feature (16)..(16): n is a, c, g, or t
  misc_feature (21)..(21): n is a, c, g, or t
  misc_feature (39)..(39): n is a, c, g, or t
cttcgcaacaaccagnacagnagcatttaccgtgcaagnaccaaaatacctccctccccttgcaaccatgtctaggtctgtggaacctcttattgtggggcgggtgattggagaagttcttgatacatttaacccatgtgtgaagatggtaacgacctataactccaacaagcttgtcttcaatggccatgagctctacccatcagcggttgtatctaaaccacgagtagaggtccaagggggtgacttgcgatccttgttcacactggttatgacagaccctgatgtgccagggccaagtgatccatatctaagggagcaccttcactggattgttactgatatacctgggacaacagatgcttcttttggacgggaagtcataagctatgagagcccaaaacccaacataggcatccacaggttcatttttgtgctcttcaagcagaagcgaaggcagactgtaactgtgccttccttcagggatcatttcaacacccgtcagtttgctgcggagaatgacctcggcctccctgtggcagctgtctacttcaactgtcagagggagactgctgccaggaggcgctgaaaatccag

SEQ ID NO: 22 - protein, 173 aa, Triticum aestivum
MSRSVEPLIVGRVIGEVLDTFNPCVKMVTTYNSNKLVFNGHELYPSAVVSKPRVEVQGGDLRSLFTLVMTDPDVPGPSDPYLREHLHWIVTDIPGTTDASFGREVISYESPKPNIGIHRFIFVLFKQKRRQTVTVPSFRDHFNTRQFAAENDLGLPVAAVYFNCQRETAARRR

SEQ ID NO: 23 - DNA, 834 bp, Solanum lycopersicum
agtagattttgttttgtttcttataattaattaataattaactctaaatatatatatggcttccaaaatgtgtgaaccccttgtgattggtagagtgattggtgaagttgttgattatttctgtccaagtgttaagatgtctgttgtttataacaacaacaaacatgtctataatggacatgaattctttccttcctcagtaacttctaaacctagggttgaagttcatggtggtgatctcagatccttcttcacactgatcatgatagatccagatgttcctggtcctagtgatccatatctcagggaacatctacactggattgtcacagacattccaggcactacagattgctcttttggaagagaagtggttgggtatgaaatgccaaggccaaatattggaatccacaggtttgtatttttgctgtttaagcagaagaaaaggcaaacaatatcgagtgcaccagtgtccagagatcaatttagtagtagaaaattttcagaagaaaatgaacttggctcaccagttgctgctgttttcttcaattgtcagagggaaactgccgctagaaggcgttgatatatcgacaaattaaaagcatctacaattatataataattagtgctggacggactactactactatatgctttttaatattatattaatttaataagacatgcagacttaaattttatattatgtatgtatatgggggttaatggttgttcaccctcatgacttaatgccaatggcttaattataagcacaatgtaatgtaatatcatcaatgtttcacttaattaatataattctatgtgtgttttctc

SEQ ID NO: 24 - protein, 175 aa, Solanum lycopersicum
MASKMCEPLVIGRVIGEVVDYFCPSVKMSVVYNNNKHVYNGHEFFPSSVTSKPRVEVHGGDLRSFFTLIMIDPDVPGPSDPYLREHLHWIVTDIPGTTDCSFGREVVGYEMPRPNIGIHRFVFLLFKQKKRQTISSAPVSRDQFSSRKFSEENELGSPVAAVFFNCQRETAARRR

SEQ ID NO: 25 - DNA, 522 bp, Populus trichocarpa
atgtcaagggccatggaaccactgactgtcgggagagttgtgggagatgtggtggatatattcactcctagtgtgagaatgactgttacttataactccaacaaacaagttgccaatggctatgaattcatgccttctgtcattgcttataaacctagagttgagattggtggtgaggacatgaggactgcatatacactaatcatgacagaccctgatgctccaagccccagtgatccttacctaagagaacatctccactggatggtcactgacattcctggcacaactgatgtttcctttggaagggaaattgtgagctatgagactccaaagcccgtggttggtatccatagatatgtgttcatcttatttaaacagagaggaaggcaaactgtgaggccaccagcttcaagagactgtttcaacactagaatgttcgcaggagaaaatggattgggcctgccagtggctgcagtgtactttaatgcacagagagaaactgctgcgaggagaaggtga

SEQ ID NO: 26 - protein, 173 aa, Populus trichocarpa
MSRAMEPLTVGRVVGDVVDIFTPSVRMTVTYNSNKQVANGYEFMPSVIAYKPRVEIGGEDMRTAYTLIMTDPDAPSPSDPYLREHLHWMVTDIPGTTDVSFGREIVSYETPKPVVGIHRYVFILFKQRGRQTVRPPASRDCFNTRMFAGENGLGLPVAAVYFNAQRETAARRR

SEQ ID NO: 27 - DNA, 522 bp, Antirrhinum majus
atgtctaggctagtggaaccactttcagtaggaagagttattggagaagttgttgatagtttcattcctagtgtgaggttgaatgtaacctacaatagcaacaaacaggtctctaatggctatgagttcatgcctgctgttattatggctaaaccgcgagtcgatattggaggtgaagacatgagggctgcttatacacttgtcatgactgatcctgatgctccaagccccagtgatccatatctgagggaacatctccactggatagtcacagacattccaggcaccacagatgtttcttttgggagggagattgtgagctatgagactccaaaaccagtgatcggcatccatcgctacgtgtttgttctgttcaggcagagagcaaggcaatctgtgaggcctccggcttcgcgggattgtttcaataccagaaggtttgcagatgagaatggtttaggatcaccagtggctgctgtgtattttaatgcacaaagagagactgcttgcagaaaaagatga

SEQ ID NO: 28 - protein, 173 aa, Antirrhinum majus
MSRLVEPLSVGRVIGEVVDSFIPSVRLNVTYNSNKQVSNGYEFMPAVIMAKPRVDIGGEDMRAAYTLVMTDPDAPSPSDPYLREHLHWIVTDIPGTTDVSFGREIVSYETPKPVIGIHRYVFVLFRQRARQSVRPPASRDCFNTRRFADENGLGSPVAAVYFNAQRETACRKR

SEQ ID NO: 29 - DNA, 534 bp, Arabidopsis thaliana
atgtcaagagaaatagagccactaatagtgggaagagtgataggagatgtactcgaaatgtttaatccaagtgtgacaatgagagtcactttcaattccaacacaatcgtatccaatggtcacgagctcgcgccttctcttctcctctctaagcctcgcgttgagatcggtggccaagatcttcgttccttcttcaccttaatcatgatggaccccgatgccccgagtcctagtaatccttatatgcgtgaatatctgcattggatggtgacagatattcccgggacaaccgatgcttcttttgggagagagatagtgagatatgagacgcctaaaccggtggcgggaatacacagatacgtctttgcgctattcaaacagagagggaggcaagctgtgaaggcagcgccggaaactagagagtgtttcaacacaaacgctttctcttcttactttggtctttctcaacctgttgctgctgtttacttcaacgcccaacgtgaaactgctcctcgacgacgtccttcttattaa

SEQ ID NO: 30 - protein, 177 aa, Arabidopsis thaliana
MSREIEPLIVGRVIGDVLEMFNPSVTMRVTFNSNTIVSNGHELAPSLLLSKPRVEIGGQDLRSFFTLIMMDPDAPSPSNPYMREYLHWMVTDIPGTTDASFGREIVRYETPKPVAGIHRYVFALFKQRGRQAVKAAPETRECFNTNAFSSYFGLSQPVAAVYFNAQRETAPRRRPSY

SEQ ID NO: 31 - DNA, 534 bp, Brassica napus
atgtcaagagaaatagaaccactaatagtgggaagagtgataggagatgtcatagaaatgttcaatccaagtgtgactatgagagtcacttacaattccaacacagtcgtctccaatggtcatgagctagcaccttctgttctcctctcaaggcctcgcgtcgaaattggcggccatgatctccgttcattcttcaccttaatcatgatggaccctgatgccccgagtcctagtaatccttacatgcgtgaatatctgcattggatggtgacagatatccccgggacaaccgatgcttcttttgggagagagatggtgagatacgaaacgcctaaacctgtgattgggatacacagatacgcgtttgtgctgttcagacagagagggaggcaaacggtgaaggcggcaccggcaacaagggaatgtttcaacacaagagacttctctgctttctttggtctttctctacctgttgctgctgtttacttcaacgcccaacgtgaaactgctcctcgacgacgtccttcttactaa

SEQ ID NO: 32 - protein, 177 aa, Brassica napus
MSREIEPLIVGRVIGDVIEMFNPSVTMRVTYNSNTVVSNGHELAPSVLLSRPRVEIGGHDLRSFFTLIMMDPDAPSPSNPYMREYLHWMVTDIPGTTDASFGREMVRYETPKPVIGIHRYAFVLFRQRGRQTVKAAPATRECFNTRDFSAFFGLSLPVAAVYFNAQRETAPRRRPSY

SEQ ID NO: 33 - DNA, 522 bp, Centaurea solstitialis
atgtcaaggatgattgaaccacttgtggtaggaagagtgataggggaggtggtggacacattcataccaagtgtcaagatgaatataatctacaatctcaataagacggtctctaacgggcatgagctcatgcctaatctcattatttctaaaccccgtgtcgatattggtggcgaagatatgagatctgcatatactcttatcatgaccgatccagatgttccaggcccaagtgatccttacctaagagaacatcttcactggatcgtgacagacattcctggtacaactgatgtttcctttggacgggagattgtgagttatgagacaccaaagccagtaatcgggattcatcgatacgtgttcttactgttcaagcagaaatcaaggaaatccgtgactccaccggcttcaagagatcatttcaacactcgtacgttttgtcaagaacacgggttagggttacccgttgctgcggtatatttcaatgctcaaagagaaaatgctgctcgtcgaagatga

SEQ ID NO: 34 - protein, 173 aa, Centaurea solstitialis
MSRMIEPLVVGRVIGEVVDTFIPSVKMNIIYNLNKTVSNGHELMPNLIISKPRVDIGGEDMRSAYTLIMTDPDVPGPSDPYLREHLHWIVTDIPGTTDVSFGREIVSYETPKPVIGIHRYVFLLFKQKSRKSVTPPASRDHFNTRTFCQEHGLGLPVAAVYFNAQRENAARRR

SEQ ID NO: 35 - DNA, 522 bp, Glycine max
atgtctaggctaatggaacaaccacttgttgtgggaagagtgataggagaagtggttgacattttcagcccaagtgtaagaatgaatgttacatattccactaagcaagttgctaatggtcatgagttaatgccttctactattatggccaagccacgcgttgagattggtggtgatgacatgaggactgcttataccttgatcatgacagacccagatgctccaagtcctagtgatccacatctgagggaacatctccactggacggttacagatatccctggcaccacagatgtctcttttggtaaagagatagtgggctatgagagtccaaaaccagtaataggaatccacaggtatgtgttcattttgttcaagcagagaggaagacagacagtcaggcctccttcttcaagagaccatttcaacacaaggaggttctcagaagagaatggccttggcctaccagttgctgtagtttacttcaatgctcaaagagagactgccgcaagaaggaggtga

SEQ ID NO: 36 - protein, 173 aa, Glycine max
MSRLMEQPLVVGRVIGEVVDIFSPSVRMNVTYSTKQVANGHELMPSTIMAKPRVEIGGDDMRTAYTLIMTDPDAPSPSDPHLREHLHWTVTDIPGTTDVSFGKEIVGYESPKPVIGIHRYVFILFKQRGRQTVRPPSSRDHFNTRRFSEENGLGLPVAVVYFNAQRETAARRR

SEQ ID NO: 37 - DNA, 519 bp, Glycine max
atgtctaggctcatggaaccacttgttgtgggaagagtgataggagaagtggtcgacattttcagcccaagtgtaaaaatgaatgtgacatattccaccaagcaagttgccaatggtcatgagttaatgccttctactattatggccaagccacgcgttgagattggtggtgatgacatgaggactgcttataccttgatcatgactgacccagatgctccaagtcctagtgacccatgtctaagggaacatctccactggatggttacagatatccctggcaccacagatgtctcttttggaaaagagattgtaggctatgagagtccaaagccagtaataggaatccacaggtatgtgttcatcttgttcaagcagagaggaagacaaacagtgaggcctccatcttcaagagaccacttcaacacaaggaggttctcagaagagaatggccttggcctaccagttgctgcagtttacttcaatgctcaaagagagactgctgcaagaaggaggtga

SEQ ID NO: 38 - protein, 172 aa, Glycine max
MSRLMEPLVVGRVIGEVVDIFSPSVKMNVTYSTKQVANGHELMPSTIMAKPRVEIGGDDMRTAYTLIMTDPDAPSPSDPCLREHLHWMVTDIPGTTDVSFGKEIVGYESPKPVIGIHRYVFILFKQRGRQTVRPPSSRDHFNTRRFSEENGLGLPVAAVYFNAQRETAARRR

SEQ ID NO: 39 - DNA, 522 bp, Helianthus annuus
atgtcaagaatgatagaaccacttgcactaggaagagtgataggagaggtggtggacacatttacaccaagtgtcaagttgaatgtgacctacaatcccaataagaccgtctcgaatggccatgagctcatgcctaatctcattatcaacaaacctcatgtcgatatcggtggtgaagacatgagatctgcttatacacttatcatgaccgatccagatgttccaggccctagtgatccttacttaagagaacatctccactggatcgttacagacattcctggtaccactgacacttcctttggaagggaaattgtaagctatgagacaccgaagccggtaatagggattcaccgatatgtattcttattgttcaagcagaaaacaagaaaatcggtgagtccaccggcttccagggaccgcttcaatactcgtagcttcagtcaagaacatggattagggttgccggttgctgctgtatatttcaatgctcaaagagaaaatgctgctcgcagaagatga

SEQ ID NO: 40 - protein, 173 aa, Helianthus annuus
MSRMIEPLALGRVIGEVVDTFTPSVKLNVTYNPNKTVSNGHELMPNLIINKPHVDIGGEDMRSAYTLIMTDPDVPGPSDPYLREHLHWIVTDIPGTTDTSFGREIVSYETPKPVIGIHRYVFLLFKQKTRKSVSPPASRDRFNTRSFSQEHGLGLPVAAVYFNAQRENAARRR

SEQ ID NO: 41 - DNA, 507 bp, Helianthus tuberosus
atgtcccttgtcgtagggcgggtgataggggatgtcgttgaccaattcacaccaagcgtgacgatggatgtagtctataatccccagtgcccggtcttaaacggccatgagatcaggcctaatctcattaccactaaacctcgtgttaatatcggtggtgttgacatgagatcatcttatactcttgtcatgactgacccggatgctccaagtccaagtgacccgtacttgagagaacatcttcattggattgtcacagacattcctggtacaactgatgcaacttttggaagggagattgtgagctatgaaaaaccaaagccagtgataggaatccatcgctatgtgttcttattgttcaagcaaagagctaggcggtcggtgaggcaaccagtttcgcgagatcgattcaacactcgtgccttctctcaagaaaacgacttggggctacctgttgctgctagctacttccttgctcaacgagaaaatgccccccgcagaagataa

SEQ ID NO: 42 - protein, 168 aa, Helianthus tuberosus
MSLVVGRVIGDVVDQFTPSVTMDVVYNPQCPVLNGHEIRPNLITTKPRVNIGGVDMRSSYTLVMTDPDAPSPSDPYLREHLHWIVTDIPGTTDATFGREIVSYEKPKPVIGIHRYVFLLFKQRARRSVRQPVSRDRFNTRAFSQENDLGLPVAASYFLAQRENAPRRR

SEQ ID NO: 43 - DNA, 525 bp, Malus domestica
atgtcaaggatgatggagccactaactcttggaagagtgataggagaggttgtggacatcttcaccccaactgtgaacctgaatgtagtttacaacccaaacagacaagttgctaatggacatgagctcatgccttctgtcattgctgctaaacctcgcgtcgagatcggaggtgaagatatgaggactgcttataccttaataatgacagacccagattttccaagccccagcgaaccatacctgagagaacatctccactggatggtcacagacattcctggcaccactgatgtctcatttggaaaagagattgtcgagtatgaaattccacggccggtcgtaggcattcacaggtacgtattcctgctattcaagcagagaggaagacaaacagtgagagctccagcttccagagacaatttcaataccagaatattctcgcaggagaatggtctcgggctgcctgtggctgccgtctacttcaatgcacaacgggcaactgctgctagaagaagatgttga

SEQ ID NO: 44 - protein, 174 aa, Malus domestica
MSRMMEPLTLGRVIGEVVDIFTPTVNLNVVYNPNRQVANGHELMPSVIAAKPRVEIGGEDMRTAYTLIMTDPDFPSPSEPYLREHLHWMVTDIPGTTDVSFGKEIVEYEIPRPVVGIHRYVFLLFKQRGRQTVRAPASRDNFNTRIFSQENGLGLPVAAVYFNAQRATAARRRC

SEQ ID NO: 45 - DNA, 519 bp, Medicago truncatula
atgtctaggccattggaaccactttctgtgggaagagtgataggagaagttgttgacattttcaatccaagtgtaagaatgaatgtgacatattccaccaagcaagttgcaaatggacatgagttaatgccttctattgttatgaacaaaccaagggttgatattggaggtgaagacatgagatctgcttatactttgatcatgacagacccagatgctcctagtcctagtgatccacatttaagggaacatctccactggatggttacagatattccaggtaccacagatgtctcttttggaaatgagattgtggagtatgagaatccaaagccagtgataggaatccatagatatgtgttcatcttgttcaagcagagagggagacaaacagtgagatccccatcttctagagacaatttcaacacaaggagattctcacaggagaataaccttggtttacctgttgctgcagtttacttcaatgctcaaagagaaactgcagcaagaagaaggtga

SEQ ID NO: 46 - protein, 172 aa, Medicago truncatula
MSRPLEPLSVGRVIGEVVDIFNPSVRMNVTYSTKQVANGHELMPSIVMNKPRVDIGGEDMRSAYTLIMTDPDAPSPSDPHLREHLHWMVTDIPGTTDVSFGNEIVEYENPKPVIGIHRYVFILFKQRGRQTVRSPSSRDNFNTRRFSQENNLGLPVAAVYFNAQRETAARRR

SEQ ID NO: 47 - DNA, 525 bp, Nicotiana tabacum
atggcttctagggttgttgaaccacttgttgttgcacgagtgataggagaagtagtagacagtttcaacccaagtgtgaaactgaatgtgatatacaacgggagcaaacaagtatttaatgggcatgaactcatgcctgctgtcattgctgctaaacctcgtgtcgagattggtggcgaagacatgcgatctgcttacacccttatcatgaccgacccagatgttccaggtcctagtgatccttacttgagggaacacctccactggattgttacagatattcctggttccactgattcctcgttcggaagggaaatagtgagctacgagagcccaaagccagtgattgggattcaccgatatgtgttactattgtataaacaaagcggaaggcaaacagtgaaaccagcagcaacaagagaccatttcaacactcgaaggtatacggctgagaatggattgggaagcccagttgccgctgtctacttcaatgcccagagagaaactgctgccagaagaagatga

SEQ ID NO: 48 - protein, 174 aa, Nicotiana tabacum
MASRVVEPLVVARVIGEVVDSFNPSVKLNVIYNGSKQVFNGHELMPAVIAAKPRVEIGGEDMRSAYTLIMTDPDVPGPSDPYLREHLHWIVTDIPGSTDSSFGREIVSYESPKPVIGIHRYVLLLYKQSGRQTVKPAATRDHFNTRRYTAENGLGSPVAAVYFNAQRETAARRR

SEQ ID NO: 49 - DNA, 528 bp, Solanum tuberosum
atgtcttgtagagatattgaaccacttattgttgcaagagtgattggagaagtagttgatagtttcaatccaagtgtgaaaatgaatgtgatatataatggaagcaaacaagtgtttaatggtcacgaactcatgcctcctatcattgcttctaagcctcgtgtggagattggtggtgaagacatgagatctgcttatacactcatcatgactgatccagatgttccaggtcctagtgatccttacttaagggaacacctccactggattgtgacagatattcctggttcaactgatgcttcttttggaaaagagatagtgagctacgatagtccaaaaccagtgatcgggattcatcgatacgtgttcgtattatataggcaaaatagaggaagacaaacagtgaaatcaccagtaacaagagatcatttcaacactcaaaaatttgcagcagaaaatggattgggttcccctgttgctgctgtctactttaatgcccaaagagaaactgctgctagaagaagatga

SEQ ID NO: 50 - protein, 175 aa, Solanum tuberosum
MSCRDIEPLIVARVIGEVVDSFNPSVKMNVIYNGSKQVFNGHELMPPIIASKPRVEIGGEDMRSAYTLIMTDPDVPGPSDPYLREHLHWIVTDIPGSTDASFGKEIVSYDSPKPVIGIHRYVFVLYRQNRGRQTVKSPVTRDHFNTQKFAAENGLGSPVAAVYFNAQRETAARRR

SEQ ID NO: 51 - DNA, 522 bp, tagete erecta
atgtcaagaatgaacgaaccacttgccgtaggaagagtgataggagaggtggtggacacattcacaccaagcgtcaagctgaatgtaacctacaatctcaataagactgtctgtaatggccatgagctcatgccaaatctcattgctactaaaccgcgtgtcgatattggtggtgaagacatgagatctgcttatacacttatcatgaccgatccagacgtcccaggcccaagtgatccctacttaagagaacatctccactggattgtgacagacattcctggtaccactgatgcttcttttggaagggaaattgtaagctatgaggcaccgaagccggtgattgggattcatcgatacgtgtttttactgtttaagcagaaaacaagaaaatcagtgtgtccaccagattctcgagaccgtttcaacactcgcagcttcagtcaagaacatgggttagggttaccagttgctgctgtgtatttcaatgctcaaagagaaaatgcagcccgcagaagatga

SEQ ID NO: 52 - protein, 173 aa, tagete erecta
MSRMNEPLAVGRVIGEVVDTFTPSVKLNVTYNLNKTVCNGHELMPNLIATKPRVDIGGEDMRSAYTLIMTDPDVPGPSDPYLREHLHWIVTDIPGTTDASFGREIVSYEAPKPVIGIHRYVFLLFKQKTRKSVCPPDSRDRFNTRSFSQEHGLGLPVAAVYFNAQRENAARRR

SEQ ID NO: 53 - DNA, 522 bp, Vitis vinifera
atgtccaggaacatggagcctctcagtgtagggagagtggtgggagatgtagtggatggtttcaccccaagtgtgaaaatgagtgtcacttacaactccaataagcaagttgctaatggccatgagctgatgccctctgttgttactgctaaacctagagtggaggttggtggtgaagacttaagggctgcttataccctaatcatgacagacccggatgctccaagccctagtgatccataccttaaagaacatcttcactggattgtggctgacattcccggtaccactgatgcttcctttggaaaagaaattgtgagctacgagcccccaaagccggtaattggcatccacagatatgcgttcatcttgtttaagcagagaggaagagaaaccgtgatgccaccagcttcaagagaccatttcaacacaaggaagtttgcagaagacaacggtttaggatcgccagtggcagcagtatacttcaatgcacagagaccaactgcagcaagaagaagatga

SEQ ID NO: 54 - protein, 173 aa, Vitis vinifera
MSRNMEPLSVGRVVGDVVDGFTPSVKMSVTYNSNKQVANGHELMPSVVTAKPRVEVGGEDLRAAYTLIMTDPDAPSPSDPYLKEHLHWIVADIPGTTDASFGKEIVSYEPPKPVIGIHRYAFILFKQRGRETVMPPASRDHFNTRKFAEDNGLGSPVAAVYFNAQRPTAARRR

SEQ ID NO: 55 - DNA, 528 bp, Brassica napus
atggcccgaatttcttcagacccgcttatggttgggagagtgattggagacgttgtggacaattgtttgcaggcagtgaaaatgacagtgacctataactccgacaagcaagtctacaatggccatgaacttttcccttctgtggttacaaacaaacctaaggttgaagttcatgggggtgacatgagatcattcttcactttggtcatgactgatcctgatgttcctggacctagcgatccttatctgagggagcacttgcactggattgttacggatatcccagggacaaccgacgtgacatttggaaaggaaatagtagggtacgagatgcctcggccaaacatagggatccaccggtttgtgtatttgcttttcaagcagaactgtagaggaagtgtgatttctgtgccgtcttacagagaccaattcaacactcgaatgtttgcacatgagaacgatctcggcctccccgttgcagctgttttcttcaactgccagcgtgaaaccgctgctagacgccgttga

SEQ ID NO: 56 - protein, 175 aa, Brassica napus
MARISSDPLMVGRVIGDVVDNCLQAVKMTVTYNSDKQVYNGHELFPSVVTNKPKVEVHGGDMRSFFTLVMTDPDVPGPSDPYLREHLHWIVTDIPGTTDVTFGKEIVGYEMPRPNIGIHRFVYLLFKQNCRGSVISVPSYRDQFNTRMFAHENDLGLPVAAVFFNCQRETAARRR

SEQ ID NO: 57 - DNA, 528 bp, Capsicum annuum
atggcttccaaaatgtgtgaaccccttgtgattggtagagtgattggagaagttgttgattatttctgtccaagtgttaagatgtctgttatttataactccaacaaacatgtctataatggtcacgaactctttccttcctcagttaccactaaacctagggttgaagttaatggtggtgatctcagatccttcttcacactgatcatgatagatccagatgtacctggtcctagtgatccatatctcagggaacatctacactggattgtcacggacattccaggcactacagattgctctttgggaagagaagtggttgggtatgaaatgccaaggccaaatattggaatccacaggtttgtgtttttgctgttccagcagaagaaaaggcaaacaatatcgaatgcagcactctccagggatcgattctgtactcgaaaattctcagaagaaaatgaacttggctctcctgtagctgctgttttcttcaattgtcagagggaaaccgctaccagaagacgttga

SEQ ID NO: 58 - protein, 175 aa, Capsicum annuum
MASKMCEPLVIGRVIGEVVDYFCPSVKMSVIYNSNKHVYNGHELFPSSVTTKPRVEVNGGDLRSFFTLIMIDPDVPGPSDPYLREHLHWIVTDIPGTTDCSLGREVVGYEMPRPNIGIHRFVFLLFQQKKRQTISNAALSRDRFCTRKFSEENELGSPVAAVFFNCQRETATRRR

SEQ ID NO: 59 - DNA, 525 bp, Centaurea solstitialis
atggcaagaatgatgtcagatcctcttgtgattgggagggtggtgggagatgtggtggataatttcagtccaagtgttgagatgtctgtcacctacaactcatcaaagcaagtttacaatggacatgagctgtttccttcagctgtcacagctaaacctaaggttgatgttcgtggtggtgatatgagatccttctttacactgattatgacggatccagatgttcctggtcctagtgatccatatctcagagagcacttgcactggattgttacagacattccaggcacaacggattcctcatttggaaaagaagtagtgagctatgaaatacctaggccaaacataggaatccacaggtttgtgtttttgcttttcaagcaaagtggaagacagactgttacttgcccatcttcaaggcgtagtttcaacactcgcagttttgctcatcaaaatcaactgggattgcctgttgctgctgtctttttcaactgccaaagggagactgctgccagaagacgttaa

SEQ ID NO: 60 - protein, 174 aa, Centaurea solstitialis
MARMMSDPLVIGRVVGDVVDNFSPSVEMSVTYNSSKQVYNGHELFPSAVTAKPKVDVRGGDMRSFFTLIMTDPDVPGPSDPYLREHLHWIVTDIPGTTDSSFGKEVVSYEIPRPNIGIHRFVFLLFKQSGRQTVTCPSSRRSFNTRSFAHQNQLGLPVAAVFFNCQRETAARRR

SEQ ID NO: 61 - DNA, 534 bp, Euphorbia esula
atgtccaataataataataagcataatgatcctctggtggtagggagagtgattggagaagtaatagatagttttaatccaagtgtgaaaatgacagttacttacaactcaaacaaacaggtctttaatggccatgaactttttccttctgctgttactttcaaacctaaggttgaagttcaaggtgctgacatgatatcctttttcaccctggttatgacagatcctgatgtgcctaatcctagtgatccatatctcaaggagcatttgcactggatagtgactgatatcccaggaacaacagatgcaacatttggaaaagaagtggtgagctatgagatgccaaagccaaacataggaatccatagatttgtgtttcttctgttcaaacaaaagagaagacaaacagtcaaaactccaacttccagagataaatttaattccagaaaatttgctgtagataatgaactttctcttcctgttgctgcggttttcttcaatgcccagagagaaaccgctgctagaagacgctga

SEQ ID NO: 62 - protein, 177 aa, Euphorbia esula
MSNNNNKHNDPLVVGRVIGEVIDSFNPSVKMTVTYNSNKQVFNGHELFPSAVTFKPKVEVQGADMISFFTLVMTDPDVPNPSDPYLKEHLHWIVTDIPGTTDATFGKEVVSYEMPKPNIGIHRFVFLLFKQKRRQTVKTPTSRDKFNSRKFAVDNELSLPVAAVFFNAQRETAARRR

SEQ ID NO: 63 - DNA, 531 bp, Lactuca saligna
atggcgagaagactaacgccggatcatccactggtgattgggagggtggtcggagatgtagtcgacaatttcactccgagtgtgaatatgcttgtaatgtacaacttatcaaaccaagtgtacaatgggcatgagctattgccttcttctgtcactagtaaacctaaggttgatgttaatggtggtgacttgagatccttttttacactgataatgacagacccagatgttcctaatcctagcgatccatatctcagggagcacctgcactggatggttacagatattccaggcaccactgactcctcttttggaaaagagttggtaagctacaagatgcctaaaccaaacattggtatccataggtatgtgttcttgctttttaaacagaacagaagacaaacagtgagttgtccgtcttctagggacagattcaacacgagaatgtttgctcaagaaaatgaactcggtttgcctgttggtgccatcttctttaactgtcaaagagaaactgctgctagaagacgttaa

SEQ ID NO: 64 - protein, 176 aa, Lactuca saligna
MARRLTPDHPLVIGRVVGDVVDNFTPSVNMLVMYNLSNQVYNGHELLPSSVTSKPKVDVNGGDLRSFFTLIMTDPDVPNPSDPYLREHLHWMVTDIPGTTDSSFGKELVSYKMPKPNIGIHRYVFLLFKQNRRQTVSCPSSRDRFNTRMFAQENELGLPVGAIFFNCQRETAARRR

SEQ ID NO: 65 - DNA, 525 bp, Malus domestica
atggcaatgatgtcatcagatcctcttgtggttgggagagttattggagatgttgttgattacttctccccaagtgtaaaaatgacagtcacatacaactccaacaagaaggtgtataatgggcatgagctatttccttcctcagtaaccatcaagcctaaggttgaagttcatggaggcgatttgaggagtttctttacactggtcatgacggatccagatgttcccggccccagtgacccatacctgaaggaacacttacactggattgtgaccgacatcccaggcacgactgataacacatttggaaaggaggtggtgaaatatgaaatgccaaggccaaacatagggatccacaggtttgtgtttcttctgttcaagcagaaagccaggcagacagtgatccctcctgcatcaaaggaccacttcaacacccgaaaatttgcagaggcaaatgaccttggccttccagtgactgctgtcttctttaatgcccaaagagaaactgctgcaaggagacgctaa

SEQ ID NO: 66 - protein, 174 aa, Malus domestica
MAMMSSDPLVVGRVIGDVVDYFSPSVKMTVTYNSNKKVYNGHELFPSSVTIKPKVEVHGGDLRSFFTLVMTDPDVPGPSDPYLKEHLHWIVTDIPGTTDNTFGKEVVKYEMPRPNIGIHRFVFLLFKQKARQTVIPPASKDHFNTRKFAEANDLGLPVTAVFFNAQRETAARRR

SEQ ID NO: 67 - DNA, 528 bp, Nicotiana tabacum
atgggttcaaaaatgtctgatccccttgtgattggtagagtgataggggaagttgttgattatttcactccaagtgttaagatgtctgttacttataacagcagcaagcatgtctataatggacatgaactctttccttcctcagtcacctctaaacctagggttgaagttcatggaggtgatttgagatctttctttacaatgatcatgatagacccagatgttcctggtcctagtgatccatatctcagggaacacctacactggattgtcacagacattccaggcactacagattgctcgtttgggaaagaaatagttggctatgaaatgccaaggccaaatattggaattcacaggtttgtatttctgctgttcaagcagaagaagaggcaaacagtattgactgcacctctctccagggatcgatttaatacgcgtaaattcgcagaagaaaatgagcttgggtctcctgttgcagcagttttcttcaattgccagagggaaactgctgccagaaggcgttga

SEQ ID NO: 68 - protein, 175 aa, Nicotiana tabacum
MGSKMSDPLVIGRVIGEVVDYFTPSVKMSVTYNSSKHVYNGHELFPSSVTSKPRVEVHGGDLRSFFTMIMIDPDVPGPSDPYLREHLHWIVTDIPGTTDCSFGKEIVGYEMPRPNIGIHRFVFLLFKQKKRQTVLTAPLSRDRFNTRKFAEENELGSPVAAVFFNCQRETAARRR

SEQ ID NO: 69 - DNA, 528 bp, Solanum tuberosum
atggcttccaaaatgtgtgaaccccttgtgattggtagagtgattggtgaagttgttgataatttctgtccaagtgttaagatgtctgttgtttataacaacaacaaacatgtctataatggtcatgaattctttccttcctcagtaacttctaaacctagggttgaagttcatggtggtgatctcagaaccttcttcacactggtcatgatagatccagatgttcctggtcctagtgatccatatctcagggaacatctacactggattgtcacagacattccaggcactacagattgctcttttggaagagaagtggttgggtatgaaatgccaaggccaaatattggaatccacaggtttgtatttttgctgtttaagcagaagaaaaggcaaacaatatcgagtgcaccagtgtcgagagatcaatttagtagtcgaaaattctcagaagaaaatgaacttggctcaccagttgctgctgttttcttcaattgccagagggaaactgccgctagaaggcgttga

SEQ ID NO: 70 - protein, 175 aa, Solanum tuberosum
MASKMCEPLVIGRVIGEVVDNFCPSVKMSVVYNNNKHVYNGHEFFPSSVTSKPRVEVHGGDLRTFFTLVMIDPDVPGPSDPYLREHLHWIVTDIPGTTDCSFGREVVGYEMPRPNIGIHRFVFLLFKQKKRQTISSAPVSRDQFSSRKFSEENELGSPVAAVFFNCQRETAARRR

SEQ ID NO: 71 - DNA, 534 bp, Arabidopsis thaliana
atggagaatatgggaactagagtgatagagccattgataatggggagagtggtaggagatgttcttgatttcttcactccaacaactaagatgaatgttagttataacaagaagcaagtctccaatggccatgagctctttccttcttctgtttcctccaagcctagggttgagatccatggtggtgatctcagatccttcttcactttggtgatgatagacccagatgttccaggtcctagtgacccctttctaaaagaacacctgcactggatcgttacaaacattcccggcacaacagatgctacgtttggcaaagaggtggtgagctatgaattgccaaggccaagcatagggatacataggtttgtgtttgttctgttcaggcagaagcaaagacgtgttatctttcctaatatcccttcgagagatcacttcaacactcgtaaatttgcggtcgagtatgatcttggtctccctgtcgcggccgtcttctttaacgcacaaagagaaaccgctgcacgcaaacgctag

SEQ ID NO: 72 - protein, 177 aa, Arabidopsis thaliana
MENMGTRVIEPLIMGRVVGDVLDFFTPTTKMNVSYNKKQVSNGHELFPSSVSSKPRVEIHGGDLRSFFTLVMIDPDVPGPSDPFLKEHLHWIVTNIPGTTDATFGKEVVSYELPRPSIGIHRFVFVLFRQKQRRVIFPNIPSRDHFNTRKFAVEYDLGLPVAAVFFNAQRETAARKR

SEQ ID NO: 73 - DNA, 540 bp, Brassica napus
atggagaatatgggaagtagagtgatagagccattgatagtgggaagagtggtaggagaggttcttgattttttcactcaaacaattgaaatgaacgtgagttacaacaagaagcaagtctgcaatggccatgagcttttcccttcctttgtctcctcaaagcctagggttgagatccatggcggtgatctcagatctttcttcaccttggtgatgatagaccctgatgttccaggtcctagcgacccctttttaaaagaacacctgcattggattgtgacaaacatccccggtacaacagatgcaacatttggaaaagaggtggtgagctatgagttcccaaggccaaatatagggatacacaggttcgtgtttgttctcttcaagcagaagcaaagacatgttatcgatatctccccaaacattccttcgagagataagttcaatactcgcaaatttgcgatcgagcatgatcttggtctccctgtcgcggctgtcttcttcaacgcacagagagaaaccgcagctcgcagacgttaa

SEQ ID NO: 74 - protein, 179 aa, Brassica napus
MENMGSRVIEPLIVGRVVGEVLDFFTQTIEMNVSYNKKQVCNGHELFPSFVSSKPRVEIHGGDLRSFFTLVMIDPDVPGPSDPFLKEHLHWIVTNIPGTTDATFGKEVVSYEFPRPNIGIHRFVFVLFKQKQRHVIDISPNIPSRDKFNTRKFAIEHDLGLPVAAVFFNAQRETAARRR

SEQ ID NO: 75 - DNA, 537 bp, Brassica napus
atggagaatatgggaactagagtgatagagccattaatagtgggaagagtggtcggagatgttcttgataatttcactccaacaattaaaatgaacgtgagttacaacaagaagcaagtctccaatggccatgagcttttccctttagctgtctcctccaagcctagggttgagatccatgatggtgatctcagatctttcttcaccctggtgatgacagaccctgatgttccaaatcctagtgacccctttctaaaagaacgcctgcattggctcgtcatgaacatccccggcacaacagatgctacatttggaaaagaggtggtgagctatgagctgccaaagccaaacatagggatacacaggtacgtgtttgttctgttcaggcagaagcaaagacgtgttaagttcccaagcaatattatttcgagggatcagttcaacactcgtgaatttgcgatcgagaatgatcttggtctccctgtcgcggctgtcttctttaacgctcagagagaaaccgcatctcgcagacgttag

SEQ ID NO: 76 - protein, 178 aa, Brassica napus
MENMGTRVIEPLIVGRVVGDVLDNFTPTIKMNVSYNKKQVSNGHELFPLAVSSKPRVEIHDGDLRSFFTLVMTDPDVPNPSDPFLKERLHWLVMNIPGTTDATFGKEVVSYELPKPNIGIHRYVFVLFRQKQRRVKFPSNIISRDQFNTREFAIENDLGLPVAAVFFNAQRETASRRR

SEQ ID NO: 77 - DNA, 525 bp, Festuca arundinacea
atgtcaagggcgttggagcctctcgttgtggggaaggtgatcggtgaggtgctggacagcttcaaccccaccgtgaagatggcggcaacctacaactccaacaagcaggtgttcaacggccatgagttcttcccctcggccatcgccgcgaagccgcgtgtcgaggttcaggggggcgaccttagatccttcttcacattggtgatgactgaccctgatgtgccaggacccagtgatccgtacctgagggagcatcttcactggattgttactgatattcctgggactactgatgcttcttttgggaaggaggtggtgaactacgagagcccaaagccaaacatcggcatccacaggttcatcctcgtgctgttccagcagacgcaccggggctcggtaaagaacacaccgtcgtcgagggaccgcttcaggacccgcgagttcgccaaggataacgagctcggcctccctgtcgccgctgtctacttcaacgcgcagcgggagaccgccgcccgccggcgatag

SEQ ID NO: 78 - protein, 174 aa, Festuca arundinacea
MSRALEPLVVGKVIGEVLDSFNPTVKMAATYNSNKQVFNGHEFFPSAIAAKPRVEVQGGDLRSFFTLVMTDPDVPGPSDPYLREHLHWIVTDIPGTTDASFGKEVVNYESPKPNIGIHRFILVLFQQTHRGSVKNTPSSRDRFRTREFAKDNELGLPVAAVYFNAQRETAARRR

SEQ ID NO: 79 - DNA, 522 bp, Glycine max
atggcaagaatgcctttagagcctctaatagtggggagagtcataggagaagttcttgattcttttaccacaagcacaaaaatgattgtgagttacaacaagaatcaagtctacaatggccatgaactcttcccttccactgtcaacaccaagcccaaggttgagattgagggtggtgatatgaggtccttctttacactgatcatgactgaccctgatgttcctggccctagtgacccttatctgagagagcacttgcactggatagtgacagatattccaggcacaacagatgccacatttgggaaagagttggtgagctatgagatcccaaagcctaatattgggatccataggtttgtgtttgtcctgttcaagcaaaagcgtagacagtgtgttactccacccacttcaagggaccacttcaacacacgcaaattcgcagcagagaacgaccttgccctccctgtggctgctgtctacttcaatgcacagagggaaacggctgcaagaagacgctag

SEQ ID NO: 80 - protein, 173 aa, Glycine max
MARMPLEPLIVGRVIGEVLDSFTTSTKMIVSYNKNQVYNGHELFPSTVNTKPKVEIEGGDMRSFFTLIMTDPDVPGPSDPYLREHLHWIVTDIPGTTDATFGKELVSYEIPKPNIGIHRFVFVLFKQKRRQCVTPPTSRDHFNTRKFAAENDLALPVAAVYFNAQRETAARRR

SEQ ID NO: 81 - DNA, 525 bp, Glycine max
atggcaaggatgtcgacagatcctctaattattgggagagtcataggagatgttcttggctctttcaccccaaccataaaaatgaccgtaacttacaataagaagcaagtctacaatgggtacgagttcttcccttccacaattaccacaaggccaagggttgagattggtggaggagatatgaggtccttctatacactgattatgacagacccggatgtccctggccctagtgatccttacctgagagagcatttgcactggatggtgacagacattccaggcacaacaaatgcctcatttgggaaagtgttggtgagctatgagatgccaaaccctaacattgggatacacaggtatgtgtttgtcctgttgaagcaaaaacgtaggcagtgtgtaactcgtccaccttcttcaagggatcacttcaacactcgcaaattctcagctgagaatgaccttggcctccctgttgctgctgtctacttcaatgcacagagggaaactgctgcaagaagacgctag

SEQ ID NO: 82 - protein, 174 aa, Glycine max
MARMSTDPLIIGRVIGDVLGSFTPTIKMTVTYNKKQVYNGYEFFPSTITTRPRVEIGGGDMRSFYTLIMTDPDVPGPSDPYLREHLHWMVTDIPGTTNASFGKVLVSYEMPNPNIGIHRYVFVLLKQKRRQCVTRPPSSRDHFNTRKFSAENDLGLPVAAVYFNAQRETAARRR

SEQ ID NO: 83 - DNA, 522 bp, Glycine max
atggcaaagatgtggacagatcctctatttattgggagagttataggagatgttcttgactctttcaccccaaccataaaaatgaccgtaacttacaagaagcaagtctacaatgggcacgagttcttcccttccacaattaccacaaggccgaaggttgagattggtggaggagatatgaggtcattctatacactgattatgactgacccggatgtccctggtcctagtgatccttacctgagagagcatttgcactggatggtgacagacattccaggcacaacaaatgcctcatttgggaatgtgttggtgagctatgagatgccaaagcctaacatagggatacacaggtatgtgtttgtcctgtttaagcaaaaacgtaggcagtgtgtaactcgtccaccttcttcaagggatcacttcagcactcgcaaattctcagctgagaatgaccttggcctccctgtcgcttctgtctacttcaatgcacagagagaaactgctgcaagaagacgctag

SEQ ID NO: 84 - protein, 173 aa, Glycine max
MAKMWTDPLFIGRVIGDVLDSFTPTIKMTVTYKKQVYNGHEFFPSTITTRPKVEIGGGDMRSFYTLIMTDPDVPGPSDPYLREHLHWMVTDIPGTTNASFGNVLVSYEMPKPNIGIHRYVFVLFKQKRRQCVTRPPSSRDHFSTRKFSAENDLGLPVASVYFNAQRETAARRR

SEQ ID NO: 85 - DNA, 522 bp, Glycine max
atggcaaaaatgcctttagagcctctaatagtggggagagtcataggagaagttcttgattctttcaccacaagcacaaaaatgactgtgagttacaacaagaagcaagtttacaatggccatgagctcttcccttccactgtcaacaccaagcccaaggttgagattgagggtggtgatatgaggtccttctttacactgatcatgactgaccctgatgttcctggccctagtgacccttatctgagagagcacttgcactggatagtgacagatattccaggcacaacagatgccacatttgggaaagagttggtgagctatgaggtcccaaagcctaatattggaatccataggtttgtgtttgtcctgttcaagcaaaagcgtagacagtgtgttactccacccacttcaagggaccacttcaacacacgcaaattcgcagcagagaacgaccttggcctccctgtggctgctgtctacttcaatgcacagagggaaacggctgcaagaagacgctag

SEQ ID NO: 86 - protein, 173 aa, Glycine max
MAKMPLEPLIVGRVIGEVLDSFTTSTKMTVSYNKKQVYNGHELFPSTVNTKPKVEIEGGDMRSFFTLIMTDPDVPGPSDPYLREHLHWIVTDIPGTTDATFGKELVSYEVPKPNIGIHRFVFVLFKQKRRQCVTPPTSRDHFNTRKFAAENDLGLPVAAVYFNAQRETAARRR

SEQ ID NO: 87 - DNA, 522 bp, Hordeum vulgare
atgtctaggtctgtggaacctcttattgtggggcgggtgattggagaagttcttgatacatttaacccatgtgtcaagatggtgacgacttataattccaacaagcttgtcttcaatggccatgagctctacccatcagcggttgtatctaaaccacgagtagaggtccaaggggatggcctgcgatccttgttcacactggttatgacagaccctgatgtgccaggaccaagtgatccatatctaagggagcaccttcactggattgttactgatatacctgggacaacagatgcttcttttggacgggaagtcataagctatgagagcccaaagcccaacataggcatccacaggttcatttttgtgctcttcaagcagaagcgaaggcagactgtaactgtgccttccttcagagatcagttcaacacccgtcagtttgctgaggagaatgacctcggcctcccagtggcagctgtatacttcaactgtcagagagagactgctgccaggaggcgctga

SEQ ID NO: 88 - protein, 173 aa, Hordeum vulgare
MSRSVEPLIVGRVIGEVLDTFNPCVKMVTTYNSNKLVFNGHELYPSAVVSKPRVEVQGDGLRSLFTLVMTDPDVPGPSDPYLREHLHWIVTDIPGTTDASFGREVISYESPKPNIGIHRFIFVLFKQKRRQTVTVPSFRDQFNTRQFAEENDLGLPVAAVYFNCQRETAARRR

SEQ ID NO: 89 - DNA, 525 bp, Lotus japonicus
atgtcaaaaataatgtccacagatcctctagttgttggaagagtggtaggagatgtacttgatagtttcaccactagcatgaaattgactgtgagtttcaataacaagcaagtgttcaatggccatgagttcttcccttccactattaacaccaagcccaaggttgatattggtggtggtgacatgaggtccttctttacactgatcatgacagacccagatgttcctggacctagtgatccttatctcaaagagcacctgcactggatggtgactgatattcccggaacaacagatgccacatttggaaaagagttggtgagctatgagattccaaagcctaacattgggatccataggtttgtgtttgtcctgttcaagcaaaaacgtaggcaatgtgtgagtccaccatcttcaagggatcacttcaacactcgcagttttgcagcacagaatgaccttgctctccctgttgctgctgtctacttcaatgctcagagggaaactgctgcaagaagacgctag

SEQ ID NO: 90 - protein, 174 aa, Lotus japonicus
MSKIMSTDPLVVGRVVGDVLDSFTTSMKLTVSFNNKQVFNGHEFFPSTINTKPKVDIGGGDMRSFFTLIMTDPDVPGPSDPYLKEHLHWMVTDIPGTTDATFGKELVSYEIPKPNIGIHRFVFVLFKQKRRQCVSPPSSRDHFNTRSFAAQNDLALPVAAVYFNAQRETAARRR

SEQ ID NO: 91 - DNA, 525 bp, Medicago truncatula
atggcaagaatgtctcaagaaccactcattgttggaagagtgataggagaagttcttgattcctttaccacaagcatgaaaatgactgtgagttacaacaagaagcaagtcttcaatggccatgagtttttcccttccactatcaacaccaaacccaaagttgagattgatggtggtgacatgaggtccttctatacactggtgatgacagaccctgatgttcctggccctagtgatccttatctaagagaacacttgcactggattgtgacagatattcctggaacaacagatgctacatttgggaaagaagtagtgagctatgagataccaaagccaaatataggtatacacaggtttgtgtttgttctattcaaacaaaagaatagagaatcagtgacagcatcaccatcttcaagggattacttcaacactcgcaattttgcttcacagaatgatcttggtctccctgttgctgctgtttacttcaatgctcagagagaaaccgctgcaagaagacgctag

SEQ ID NO: 92 - protein, 174 aa, Medicago truncatula
MARMSQEPLIVGRVIGEVLDSFTTSMKMTVSYNKKQVFNGHEFFPSTINTKPKVEIDGGDMRSFYTLVMTDPDVPGPSDPYLREHLHWIVTDIPGTTDATFGKEVVSYEIPKPNIGIHRFVFVLFKQKNRESVTASPSSRDYFNTRNFASQNDLGLPVAAVYFNAQRETAARRR

SEQ ID NO: 93 - DNA, 522 bp, Oryza sativa
atgtcgagggtgctggagcctctcattgtggggaaggtgatcggcgaggtgctggacaacttcaaccccacggtgaagatgacggccacctacggcgccaacaagcaggtgttcaacggccacgagttcttcccctccgccgtcgccggcaagccgcgcgtcgaggtccagggcggcgacctcaggtccttcttcacattggtgatgactgaccctgatgtgccagggcctagtgatccatacctgagggagcatcttcactggattgttactgatattcctgggactactgatgcctcttttgggagggaggtggtgagctacgagagcccgcggccaaacatcggcatccacaggttcatcctggtgctgttccggcagaagcgccggcaggcggtgagcccgccgccgtcgagggaccgcttcagcacccgccagttcgccgaggacaacgacctcggcctccccgtcgccgccgtctacttcaacgcgcagcgcgagaccgccgctcgccgccgctaa

SEQ ID NO: 94 - protein, 173 aa, Oryza sativa
MSRVLEPLIVGKVIGEVLDNFNPTVKMTATYGANKQVFNGHEFFPSAVAGKPRVEVQGGDLRSFFTLVMTDPDVPGPSDPYLREHLHWIVTDIPGTTDASFGREVVSYESPRPNIGIHRFILVLFRQKRRQAVSPPPSRDRFSTRQFAEDNDLGLPVAAVYFNAQRETAARRR

SEQ ID NO: 95 - DNA, 522 bp, Oryza sativa
atgtctagggtgctggagcctctcgtcgtcgggaaggtgatcggagaggtcatcgacaacttcaaccccacggtgaagatgacggcgacctacagctccaacaagcaggtgttcaacggccacgagttattcccgtcggcggtcgtgtccaagccgcgagtcgaggttcagggcggcgacctgaggtctttcttcacactggttatgacagatccagacgtgccagggcctagtgatccgtacctgagggagcacctccactggatcgtcactgatattcctggcaccactgatgcttcctttgggagggaggtggtgagctacgagagcccgaagcccaacattggcatccacaggttcgtcctcgtgctgttcaagcagaagcgccgtcaggcggtgaccccgccatcctccagggactacttcagcacccgccgcttcgccgccgacaacgacctcggcctccccgtcgccgccgtctacttcaacgcgcagcgagagacggccgctcgccgccgctaa

SEQ ID NO: 96 - protein, 173 aa, Oryza sativa
MSRVLEPLVVGKVIGEVIDNFNPTVKMTATYSSNKQVFNGHELFPSAVVSKPRVEVQGGDLRSFFTLVMTDPDVPGPSDPYLREHLHWIVTDIPGTTDASFGREVVSYESPKPNIGIHRFVLVLFKQKRRQAVTPPSSRDYFSTRRFAADNDLGLPVAAVYFNAQRETAARRR

SEQ ID NO: 97 - DNA, 522 bp, Oryza sativa
atgtctaggtctgtggagcctcttgttgtagggcgcgtgattggggaagttcttgatacctttaacccatgcatgaagatgatagtgacctataactccaacaagcttgtatttaatggtcatgagctctacccatcagcagttgtgtctaaaccaagagttgaggtccaagggggtgacctgcgatctttcttcacattggttatgacagacccagatgtgccaggaccaagtgatccttatctaagggagcaccttcattggattgttactgatatacctgggacaacggatgcttcttttggacgcgaggtcataagctatgagagtccaaagccgaacattggcatccataggttcatttttgtgctcttcaagcagaagcgcaggcaaactgtaattgtgccatccttcagggaccatttcaacacccgccggttcgccgaggagaatgatcttggccttcctgtggctgctgtctacttcaatgcccagagagagactgcagccaggaggcgctga

SEQ ID NO: 98 - protein, 173 aa, Oryza sativa
MSRSVEPLVVGRVIGEVLDTFNPCMKMIVTYNSNKLVFNGHELYPSAVVSKPRVEVQGGDLRSFFTLVMTDPDVPGPSDPYLREHLHWIVTDIPGTTDASFGREVISYESPKPNIGIHRFIFVLFKQKRRQTVIVPSFRDHFNTRRFAEENDLGLPVAAVYFNAQRETAARRR

SEQ ID NO: 99 - DNA, 522 bp, Sorghum bicolor
atgtcaagggtgttggagcctctcattgtggggaaagtgattggtgaggtgctggaccatttcaaccccacggtgaagatggtggtcacctacaactccaacaagcaggtcttcaacggacatgagttcttcccttccgcagtcaccgccaagccgcgtgttgaggtccaagggggtgacctcaggtccttcttcacattggtgatgactgaccctgatgttccaggacctagtgatccctacctgagggagcaccttcactggattgttactgatattcctgggactactgatgcttcttttgggagagaggtggtgagctacgagaccccaaagccaaacattggcatccacaggttcatctttgtgctgttccggcagaagcgccggcaggcggtgaacccgccgtcgtccaaggaccgcttcagcacccgccagttcgctgaggacaacgacctcggcctccccgtcgccgccgtctacttcaacgcacagcgcgagaccgccgcccgccggcgctaa

SEQ ID NO: 100 - protein, 173 aa, Sorghum bicolor
MSRVLEPLIVGKVIGEVLDHFNPTVKMVVTYNSNKQVFNGHEFFPSAVTAKPRVEVQGGDLRSFFTLVMTDPDVPGPSDPYLREHLHWIVTDIPGTTDASFGREVVSYETPKPNIGIHRFIFVLFRQKRRQAVNPPSSKDRFSTRQFAEDNDLGLPVAAVYFNAQRETAARRR

SEQ ID NO: 101 - DNA, 522 bp, Sorghum bicolor
atgtctagatctgtggagtctctcatagttggtcgggtgattggagaagttctcgactcctttagcccatgtgtgaagatggtagtgacctacaactcaaacaagcttgtcttcaatggccatgagatctacccatcagcagttgtatccaaaccaagagtagaggttcaagggggtgacttgcggtctttcttcacattggttatgacagacccagatgttccagggccaagtgatccatatctaagggagcaccttcactggatcgtgactgatatacctgggacaacagatgcctcattcgggcgagaagttataagctatgagagcccaagacctagcattggtatccacaggttcatttttgttctcttcaagcagaagcgcaggcaaactgtagctatgccatcctccagggaccatttcatcacacgacagtttgctgaggaaaatgatcttggactccctgtagctgctgtctacttcaacgctcagagagaaactgctgctaggaggcgctga

SEQ ID NO: 102 - protein, 173 aa, Sorghum bicolor
MSRSVESLIVGRVIGEVLDSFSPCVKMVVTYNSNKLVFNGHEIYPSAVVSKPRVEVQGGDLRSFFTLVMTDPDVPGPSDPYLREHLHWIVTDIPGTTDASFGREVISYESPRPSIGIHRFIFVLFKQKRRQTVAMPSSRDHFITRQFAEENDLGLPVAAVYFNAQRETAARRR

SEQ ID NO: 103 - DNA, 522 bp, Sorghum bicolor
atgtctagggtgttggaacctctagtcgtcggcaaggtgattggggaagtcatcgacaacttcaaccccacggtgaagatgacggttacctacggctccaacaaccaggtgttcaacggccatgagttctttccgtctgcggttctgtccaagccgcgcgtggaggttcagggcgacgacatgaggtccttcttcacgctggtcatgactgacccagatgtgccagggcctagtgatccatacctgagagagcatctccattggatcgtcactgacattcctggaacaactgatgcttcttttggaacggagttggcgatgtacgagagccccaaaccctacatcggcatccacaggttcgtcttcgtgctgttcaagcagaagagccgccagtcggtgcgcccgccctcgtccagggactacttcagcacccgccgctttgccgccgacaacgatctcggcctcccagtcgctgccgtctacttcaacgcgcagcgggagaccgccgcgcgccgccgctga

SEQ ID NO: 104 - protein, 173 aa, Sorghum bicolor
MSRVLEPLVVGKVIGEVIDNFNPTVKMTVTYGSNNQVFNGHEFFPSAVLSKPRVEVQGDDMRSFFTLVMTDPDVPGPSDPYLREHLHWIVTDIPGTTDASFGTELAMYESPKPYIGIHRFVFVLFKQKSRQSVRPPSSRDYFSTRRFAADNDLGLPVAAVYFNAQRETAARRR

SEQ ID NO: 105 - DNA, 522 bp, Sorghum bicolor
atgtctaggtctgtggagcctctcatagttgggcgggtgattggagaagttctcgactcctttaacccatgtgtgaagatgatagtgacctacaactcaaacaaacttgtattcaatggccatgagatctacccatcagctgttgtatctaaacctagggtagaggttcaagggggtgacttgcggtctttcttcacattggttatgacggacccagatgtcccaggaccaagtgatccatatctaagggagcaccttcattggatcgtgactgatatacctgggacaacagatgcctcctttgggcgagaggtcataagctacgagagcccaagaccaaacattggtatccacaggttcatttttgtgctcttcaagcagaagggtaggcaaactgtaactgtgccatcctccagagatcatttcaacactcggcagttcgctgaggaaaatgaccttggcctccctgtagctgctgtctacttcaatgcacagagagaaactgcagctaggagacgctga

SEQ ID NO: 106 - protein, 173 aa, Sorghum bicolor
MSRSVEPLIVGRVIGEVLDSFNPCVKMIVTYNSNKLVFNGHEIYPSAVVSKPRVEVQGGDLRSFFTLVMTDPDVPGPSDPYLREHLHWIVTDIPGTTDASFGREVISYESPRPNIGIHRFIFVLFKQKGRQTVTVPSSRDHFNTRQFAEENDLGLPVAAVYFNAQRETAARRR

SEQ ID NO: 107 - DNA, 522 bp, Saccharum officinarum
atgtctagatctgtggagtctcttgtagtcggtcgggtgattggagaagttctcgacttctttagcccatgtgtgaatatggttgtgacctacaactcaaacaagcttgtcttcaatggccatgagatttacccatcagcagttgtatctaaaccaagagtagaggttcaagggggcgacttgcggtctttcttcacattggttatgacagacccagatgttccagggccaagtgatccatatctaagggagcaccttcactggatcgtgactgatatacctgggacaacagatgcctcatttgggctagaattcataagctacgagagcccaagacctagcattggtatccacaggttcatttttgttctcttcaagcagaagcgcaggcaaactgtagctgtgccatcctccaggggccatttcgtcacacgacagttcgctgaggaaaatgatcttggcctccctgtagctgctgtctacttcaacgctcagagagaaactgctgctaggaggcgctga

SEQ ID NO: 108 - protein, 173 aa, Saccharum officinarum
MSRSVESLVVGRVIGEVLDFFSPCVNMVVTYNSNKLVFNGHEIYPSAVVSKPRVEVQGGDLRSFFTLVMTDPDVPGPSDPYLREHLHWIVTDIPGTTDASFGLEFISYESPRPSIGIHRFIFVLFKQKRRQTVAVPSSRGHFVTRQFAEENDLGLPVAAVYFNAQRETAARRR

SEQ ID NO: 109 - DNA, 522 bp, Zea mays
atgtccaggtctgtggagcctctcatagtcgggcgggtgatcggagaagtcctcgactccttcaacccgtgtgtgaagatgatagtgacctacaactccaacaaactcgtgttcaatggccatgagatctacccatcagctgttgtgtccaaaccaagggtggcggttcaagggggcgatttgcggtctttcttcacattggttatgacagacccagatgttccaggaccaagtgatccatacctaagggagcaccttcattggatcgtgactgatatacctgggacaacagatgcctccttcgggcgacagatcataagctacgagagcccaagacctagcattggtatccacaggttcatttttgtgctcttcaagcagcagggtaggcaaaatgtaactgtgccatccttcagagatcatttcaacacccggcagttcgctgaggaaaatgaccttggcctccctgtagctgccgtctacttcaatgcacagagagaaactgctgctaggagacgctga

SEQ ID NO: 110 - protein, 173 aa, Zea mays
MSRSVEPLIVGRVIGEVLDSFNPCVKMIVTYNSNKLVFNGHEIYPSAVVSKPRVAVQGGDLRSFFTLVMTDPDVPGPSDPYLREHLHWIVTDIPGTTDASFGRQIISYESPRPSIGIHRFIFVLFKQQGRQNVTVPSFRDHFNTRQFAEENDLGLPVAAVYFNAQRETAARRR

SEQ ID NO: 111 - DNA, 531 bp, Zea mays
atgtctagagcgttggaacctctggtcgtcggcaaggtgatcggggaggtcatcgacaacttcaaccccacggtgaagatgacggttacctacggatccaacaagcaggtgttcaacggccatgagttctttccgtctgcggttctgtccaagccgcgcgtggaggttcagggcgacgacatgaggtccttcttcacgctggtcatgactgacccagatgtgccagggcctagtgatccatacctgagagagcacatccattggatcgtcaccgacattcctggaacaactgatgcttctttcggaagggagttggtgatgtacgagagcccgaagccgtacatcggcatccacaggttcgtcttcgtgctgttcaagcagagcagccggcagtcggcgcgcccgccctcgtccggcggcggcagggactacttcaacacccgccgctttgccgccgacaacaatcttggcctcccagttgccgcggtctacttcaacgcgcagcgggagactgccgcgcgccgccgctga

SEQ ID NO: 112 - protein, 176 aa, Zea mays; identical to SEQ ID NO: 12

SEQ ID NO: 113 - DNA, 534 bp, Zea mays
atgtctagatctgtggagtctctcgtagtcggccgggtgatcggagaagttctggactgcttcagcccatgtgtgaagatggtagtgacctacaactcaaacaggctcgtcttcaatggccacgagatctacccgtcagcagtcgtgtctaaaccaagagtagaggttcaagggggtgacttgcggtcgttcttcacattggttatgacagacccagacgtcccaggaccaagcgatccatatctaagggagcaccttcactggatcgtgactgatatacctgggacaactgatgcctcattcgggagagaagtcgtaagctatgagagcccgagacctggcattggtatccacaggttcatctttgttctcttcaagcagaagcgcaggcagcagcagactgtagcggcagtgccatcctccagcagggaccattccatcacgcgtcagttcgctgcggaaaacgatcttggccaccctgtagccgctgtgtacttcaacgcccagagagaaactgctgctaggaggcgctga

SEQ ID NO: 114 - protein, 177 aa, Zea mays
MSRSVESLVVGRVIGEVLDCFSPCVKMVVTYNSNRLVFNGHEIYPSAVVSKPRVEVQGGDLRSFFTLVMTDPDVPGPSDPYLREHLHWIVTDIPGTTDASFGREVVSYESPRPGIGIHRFIFVLFKQKRRQQQTVAAVPSSSRDHSITRQFAAENDLGHPVAAVYFNAQRETAARRR

SEQ ID NO: 115 - DNA, 522 bp, Zea mays
atgtctaggtctgtggagcctctcatagtcgggcgggtgattggagaagttctcgactcctttaacccatgtgtcaagatgatagtaacctacaactcaaacaaacttgtattcaatggccatgagatctacccatcagcaattgtatctaaacctagggtagaggttcaagggggtgatttgcggtctttcttcacattggttatgacagacccagatgttccaggaccaagtgatccatatctaagggagcaccttcattggatcgtgactgatatacctgggacaacagatgcctcctttgggcgagaggtcataagctatgagagcccaagacctaacatcggtatccacaggttcatttttgtgctcttcaagcagaagggtaggcaaactgtaaccgtgccatccttcagagatcatttcaacacccggcagtttgctgaggaaaatgaccttggcctcccagtagctgctgtctacttcaatgcacagagagaaactgcagctaggagacgttga

SEQ ID NO: 116 - protein, 173 aa, Zea mays; identical to SEQ ID NO: 10

SEQ ID NO: 117 - DNA, 522 bp, Zea mays
atgtcaagggtgttggagcctctcattgtggggaaagtgattggtgaggtcctggaccatttcaaccccacggtgaagatggtggtcacctacaactccaacaagcaggtgttcaacgggcacgagttcttcccttcggcagtggccgccaagccgcgtgttgaggtccaagggggcgacctcaggtccttcttcacgttggtgatgaccgaccccgatgttcctggacctagtgatccatacttgagggagcaccttcactggattgtcactgatattcctgggactaccgatgcttcttttgggaaagaggtggtgagctacgagatcccaaagccaaacattggcatccacaggttcatctttgtgctgttccggcagaagagccggcaagcggtgaacccgccgtcgtcgaaggaccgcttcagcacccgccagttcgctgaggagaacgacctcggcctccccgtcgccgccgtctacttcaacgcgcagcgcgagaccgccgcccgccgacgctaa

SEQ ID NO: 118 - protein, 173 aa, Zea mays
MSRVLEPLIVGKVIGEVLDHFNPTVKMVVTYNSNKQVFNGHEFFPSAVAAKPRVEVQGGDLRSFFTLVMTDPDVPGPSDPYLREHLHWIVTDIPGTTDASFGKEVVSYEIPKPNIGIHRFIFVLFRQKSRQAVNPPSSKDRFSTRQFAEENDLGLPVAAVYFNAQRETAARRR

SEQ ID NO: 119 - DNA, 53 bp, Artificial sequence
  primer 1
ggggacaagtttgtacaaaaaagcaggcttaaacaatgtcaagggccatggaa

SEQ ID NO: 120 - DNA, 50 bp, Artificial sequence
  primer 2
ggggaccactttgtacaagaaagctgggtatgaaggaaaacccacaacac

SEQ ID NO: 121 - protein, 5 aa, Artificial sequence
  motif 1
  VARIANT (3)..(3): Xaa is Leu or Ile
EHXHV

SEQ ID NO: 122 - protein, 6 aa, Artificial sequence
  motif 2
IPGTTD

SEQ ID NO: 123 - protein, 6 aa, Artificial sequence
  motif 3
  VARIANT (1)..(1): Xaa is Val, Ala or Ile
  VARIANT (6)..(6): Xaa is Tyr or Phe
XGIHRX

SEQ ID NO: 124 - protein, 15 aa, Artificial sequence
  motif 4
TRRGSVVSVPSYRDQ

SEQ ID NO: 125 - protein, 6 aa, Artificial sequence
  motif 5
  VARIANT (6)..(6): Xaa is Lys or Arg
TAARRX

SEQ ID NO: 126 - DNA, 53 bp, Artificial sequence
  primer 3
ggggacaagtttgtacaaaaaagcaggcttaaacaatggccaggatttcctca

SEQ ID NO: 127 - DNA, 47 bp, Artificial sequence
  primer 4
ggggaccactttgtacaagaaagctgggtcattcaacggcgtctagc

SEQ ID NO: 128 - DNA, 2194 bp, Oryza sativa
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctccttctcccatctataaattcctccccccttttcccctctctatataggaggcatccaagccaagaagagggagagcaccaaggacacgcgactagcagaagccgagcgaccgccttctcgatccatatcttccggtcgagttcttggtcgatctcttccctcctccacctcctcctcacagggtatgtgcctcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggatcggaatcttgcgattttgtgagtaccttttgtttgaggtaaaatcagagcaccggtgattttgcttggtgtaataaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttc

SEQ ID NO: 129 - protein, 3 aa, Artificial sequence
  tripeptide 1
END

SEQ ID NO: 130 - protein, 3 aa, Artificial sequence
  tripeptide 2
ENE

SEQ ID NO: 131 - protein, 3 aa, Artificial sequence
  tripeptide 3
ENG

SEQ ID NO: 132 - protein, 3 aa, Artificial sequence
  tripeptide 4
DNG

SEQ ID NO: 133 - protein, 3 aa, Artificial sequence
  tripeptide 5
QND

SEQ ID NO: 134 - protein, 3 aa, Artificial sequence
  tripeptide 6
VND

SEQ ID NO: 135 - protein, 3 aa, Artificial sequence
  tripeptide 7
DND

SEQ ID NO: 136 - protein, 3 aa, Artificial sequence
  tripeptide 8
ENN

SEQ ID NO: 137 - protein, 3 aa, Artificial sequence
  tripeptide 9
EYD

SEQ ID NO: 138 - protein, 3 aa, Artificial sequence
  tripeptide 10
YFG

SEQ ID NO: 139 - protein, 3 aa, Artificial sequence
  tripeptide 11
ENG

SEQ ID NO: 140 - DNA, 1040 bp, Arabidopsis thaliana
ccgtcaaatacgaatacgattctaagttttttagtctttatagtcagtctctcacagattttgtgcattcaaatcacaaagcaagtcgcgtacaatgggttctgcattcgatccccttgtcacggccactgaggatctcgccgccgtcaactcggcgccgccactctcaaacctcacgcaagaagaactcaagaaaatcgccgcttataaagccgtcgaattcgtcgaatctggaatggttatcggtctcggcactggctccaccgcgaaacacgccgtggctcgtatcagcgagcttctccgagaaggaaaactcaaggatataatcggaatccctacttcaaccacaacgcatgagcaagcggtgtctctagggataccattatccgatctagattcgcatccggtggtggatctatcaatcgatggcgccgacgaagtcgatccggctcttaatctggtgaaaggacgcggcggatcgttattgagagagaagatgattgaaggagcatctaagaagttcgttgtgattgttgatgaatcgaagcttgtcaagtatatcggaggaagcggactcgctgttccggtggaggttgttccgttctgctgcgatttcacaagggggaaactggaagagctatttagagattcgggatgtgttgcgaagctgaggatgaaaatcggatctaacggcgaagaggcggcgccggctgtgacggataataggaattatgtggtggatttgtatttggagagagatattggagatttagaggtggcgagtgaggcgatattgaggtttcctggagtagtggagcatgggatgtttctgggaatggcgactacgttgatcgtcgccggcaaatttggtgttaccgtcaaggataggtttggataaaagtgtcatttgaaaaccattagggtttatggtttgattttgattttcgatggattctctctggttctgtaaaccctttcctcctattggtttaaaactttgacttattttttaaaactttgtagaattttgacttttggag

SEQ ID NO: 141 - protein, 267 aa, Arabidopsis thaliana
MGSAFDPLVTATEDLAAVNSAPPLSNLTQEELKKIAAYKAVEFVESGMVIGLGTGSTAKHAVARISELLREGKLKDIIGIPTSTTTHEQAVSLGIPLSDLDSHPVVDLSIDGADEVDPALNLVKGRGGSLLREKMIEGASKKFVVIVDESKLVKYIGGSGLAVPVEVVPFCCDFTRGKLEELFRDSGCVAKLRMKIGSNGEEAAPAVTDNRNYVVDLYLERDIGDLEVASEAILRFPGVVEHGMFLGMATTLIVAGKFGVTVKDRFG

SEQ ID NO: 142 - DNA, 1464 bp, Arabidopsis thaliana
aaaacacaaaccctatcttttcttcttcttcttcttcgttcagtcttcactttcttttcttttctccgccaccacacaaatacattcttcattctttgtaactttcacgctattcttcctcaatatattcattcgacctcctctcttcattcttaatttctcaaaaatcttatctttctccctcatttttcccgtcgagggttccttaatctccttcctaggaacgtttcatcgatttcatatttgctttccttaatccacaacgtttcttccttcgtttttttctgcaattttgttttcctttacaccaaattcatctcttagtcttgtccaattttcgattttttttccgacaatcctgattgtttgtttttttatctgtcgggatttcgaatggcgcttgcgtatgatcctctcttcattacatcggacaaatctttgtccgcctttgatgttgcctcttcaccgcctcagcccatgaatttaacacaagacgagctcaaacgtatcgccgcttacaaagccgtggaattcgtcgagtccggcatggttctcggtctcggaaccggctccaccgccaaacacgccgtcgaccgaatcggcgagcttctccgtcaaggcaaactcgagaacatcgttggtataccaacgtctaagaagacgcaggagcaggctctgtctctcggcatccctctctctgatctcgacgcacaccctgtcatcgatctctccatcgacggcgcagacgaggtcgacccttttctcaacctggtaaaaggcagaggagggtctctgcttcgagagaagatgatcgaaggagcttctaagaagtttgtggtgattgttgacgactccaagatggtgaagcatattggtggaagcaagcttgctcttccggtggagatagtgcccttttgctggaagttcacggcggagaagctccggagtctgctggaaggatacgggtgtgaagcgaatcttcggttgggagagaaagggaaggcctttgtgacagacaatgggaattacatagtggatatgcatgtggaagaggatatgggagatttgggagcagtgagtgatgcgattctgaggctaccgggagtagtggaacatgggatgtttctggatatggcttctactgttatcattgcaggtgagcttggtgttaagatcaagaacaaacactgaaacacacaccacacctcttctcgttgattttggcctttatgtattaggagacagaggattatggtttgctctatggtttagatgatatgagattaggttttggatgatgtcactgtgaggaggatgaatgactttcttttgacagagttttggatgcattgacatcgtcgtcatcatcatcaatcaatcttgtaaacagcattttgcttcttcattgcctttgttgtgtttgaatgctcttcttttactactgggcctgtgttgggctttgct

SEQ ID NO: 143 - protein, 265 aa, Arabidopsis thaliana
MALAYDPLFITSDKSLSAFDVASSPPQPMNLTQDELKRIAAYKAVEFVESGMVLGLGTGSTAKHAVDRIGELLRQGKLENIVGIPTSKKTQEQALSLGIPLSDLDAHPVIDLSIDGADEVDPFLNLVKGRGGSLLREKMIEGASKKFVVIVDDSKMVKHIGGSKLALPVEIVPFCWKFTAEKLRSLLEGYGCEANLRLGEKGKAFVTDNGNYIVDMHVEEDMGDLGAVSDAILRLPGVVEHGMFLDMASTVIIAGELGVKIKNKH

SEQ ID NO: 144 - DNA, 1928 bp, Arabidopsis thaliana
tcgatttcattttatttcttctccaaccattctcaatcctctctctccaatggcttccttatccttcgtttcctcttctcaccttacgctacgcactccttctattgccctacgcagcactggctcttctcctcgaacctccgtttcattctccgtcaaggctcaatccgtcgcgctttcacaggacgatttgaagaagctcgcggcggagaaagctgtggaggcaattaaacctgggatggttctagggctcggaaccggatccaccgcagctttcgctgttgatcagatcgggaaactactctcttccggtgaactctacgatattgtcggtatcccaacgtcgaaacgaacggaggaacaagcacggtcgttagggattcctcttgttgggttagatacacatccgagaatcgatctcgctattgacggagcagacgaggtagatccgaatcttgatttagtcaaaggtcgtggaggtgctcttctccgtgagaaaatggtggaagctgtggctgacaagtttattgttgtggctgatgataccaaactcgttacaggactcggtggaagtggattagctatgccggtggaagttgttcaattctgctggaactttaatttgattagattgcaagacctcttcaaggaatttggatgtgaatcaaagcttagagttgatggtgatggcaagccttatgtgactgataacagtaattacattattgatttgtattttaagactcctttgaaggatggattcgctgcggctaaagagattgggaagtttcaaggagtggtggagcatggtctgtttctcggaatggctacttctgtcattatcgctggaaagaatggcgttgaagttatgaccaagtgaggttaaaagttcaatctttctcttcttctttgattgacaaatttttctcctttgtaaaattatcaattgagtttttatgtgagatcatttcaatttcgtgaattcgacaaaatcagcaaaaagttgagtcggattgagcaattagatcaataaaaatgtcaacttttatacagtggaaattgaattcataagccctaaatccagtaccaatgattcactatctaaaagcccctcctttaaactagttcttaaaccctaaccttgagagattgagaaactttcattagattggaacgaatcgcttgacgatgcgtcttccagcaactgcagccaaagccgcaactcctccgacagctccggcaaccacagcggatctaggtccagaagcagctctgtaaagcacaccagtggctaaaccagcgatcacagttgtcaacgaaccgtcgtctccgtctctcatatacgtaacaccgctctccatagcagcaaacatcaaccctacggatcctaagcaattcccgccgcgtcttgcaacgagtccaccggagttcaaaatccgattagttcggatctttagggattcgcctcgttcggcggctcgcatccccgcaattgtacccttgaaggctccgagaacagatccagtgcaataaccccaaccggtgaagaaggtgaggttctctccccatgttaagcgttttttcgtagcttcttcttcgaagagaaactcaggagaagttgggagttcgtagagcttacggtacggaagattgacttgttggtaaggattgtactgacggtacttctgctgttgttgatgcccggtgctatggttcatcggatccgccattatcagggcttctgcgtttctgctttaggcttagggtttaaggatgaatcgtgagggtttataactttcaagtcaagagcagcaaaaggaataacttcggggacaatccgaaattttttatcttttatttttaaaactgttgggctttaaattctaatcttgggctttttgggccctcttgttgtactagaacttttg

SEQ ID NO: 145 - protein, 276 aa, Arabidopsis thaliana
MASLSFVSSSHLTLRTPSIALRSTGSSPRTSVSFSVKAQSVALSQDDLKKLAAEKAVEAIKPGMVLGLGTGSTAAFAVDQIGKLLSSGELYDIVGIPTSKRTEEQARSLGIPLVGLDTHPRIDLAIDGADEVDPNLDLVKGRGGALLREKMVEAVADKFIVVADDTKLVTGLGGSGLAMPVEVVQFCWNFNLIRLQDLFKEFGCESKLRVDGDGKPYVTDNSNYIIDLYFKTPLKDGFAAAKEIGKFQGVVEHGLFLGMATSVIIAGKNGVEVMTK

SEQ ID NO: 146 - DNA, 1450 bp, Chlamydomonas reinhardtii
tctgagtcctacacaaaacaatgatgctcaaggccagtcccgctgctcgcgctgctgctcgccctgctgctcgcaacgtgcgcatgatggccgcgccggtctcaacccagctgagccaggatgagctgaagaagcaggctgcctggaaggctgttgagtacgttaagagcggcatggtggttggcctgggcacgggctcgaccgctgcgttcgcggtggaccggatcggccagctgctgaaggagggcaagctgcagaacatcgtcggtgtgcccacctcgatccgcacctacgagcaggctctgtctctgggcattcctctggccactctggatgagcagcccaagctggacgtcgccatcgatggtgccgacgaggtggaccccaacctggacgtggtgaagggccgcggtggcgctcttctgcgcgaaaagatggtggagatggcctcggctaagtttgtttgcatcgtggacgactccaagctggtcgagggcctgggcggctccaagctggccatgccggtggagattgtgcagttctgccacaagtacaccctgcagcgcctggctaacctgcccgaggtgaagggctgcgaggctaagctgcgcatgaacggcgacaagccctacgtgaccgacaacagcaactacatcgtggacctgtacttccagacccctatcaaggattcccaggccgcctccaaggccatcctgggcctggacggtgtcgttgaccacggcctgttcctggacatggtggacgtgtgcatcatcgccggcgccaccggcgtcaccgtgcaggagcgccccaaccccaagaagcactaagcggctcgtgcacgcagcggcacaacacgccgctcacaccgtaacagcgcgacgctgcagcagcggagcgaagcggagggaagcagagctttggagctgcggcgctggcgctagtgcgggagctagcggcgggtgaagcgtgtgctgggatgtgggttggtgtgtcgacacgtgtgtcttgagggctcgggaatggcggcagtccacggtcttcgcagttcttgcggtctgttgtgccggcaggatgacgcgtgacggccaacccctgcgaagggtgacggacgtagtatggctgttttgcttgaggggagcggttattgagggcctcccgttttgtttggctccaggtctgtgggggcgggcgggctcctggtggtgcatctgcgcctgtgcgcaggcccaggagtttttcctcgtacgcctgtcgcctgatcagtgctggttgctgggaaggcattgaggtgcttttggcgctgagagctaaactgttgtgaaagagtacgtgagtggagttggagccaaggactgtgaccgtatggggctataagcgcatgcgagcaagcaggaaacagacgaagcctgtgtgcaggcaggcgattgctgtaaggcaagagttgaat

SEQ ID NO: 147 - protein, 269 aa, Chlamydomonas reinhardtii
MMLKASPAARAAARPAARNVRMMAAPVSTQLSQDELKKQAAWKAVEYVKSGMVVGLGTGSTAAFAVDRIGQLLKEGKLQNIVGVPTSIRTYEQALSLGIPLATLDEQPKLDVAIDGADEVDPNLDVVKGRGGALLREKMVEMASAKFVCIVDDSKLVEGLGGSKLAMPVEIVQFCHKYTLQRLANLPEVKGCEAKLRMNGDKPYVTDNSNYIVDLYFQTPIKDSQAASKAILGLDGVVDHGLFLDMVDVCIIAGATGVTVQERPNPKKH

SEQ ID NO: 148 - DNA, 883 bp, Gossypium arboreum
ctcttttcctcctattaaacaaaagccaatggcctccttatccttcctccacctctcctccgccacccgttttaccccacgcgccactcctcttaaccaccgggctcgaacccagaaatcattctccatcaggtcccaatctgccccagtcctttcccaagatgagctcaaaaagcttgcagctgacaaagcggttgagtcagtcaagtcaggtatggtcctaggcctaggaacaggctcaacagctgcctttgtggttgacaaactgggtcaactcctttccaccggtcaactttctaacatcgtcggaatcccaacctcaaaaagaacccaagagcaagctgcatcacttaatatccctttatccacccttgacttgcatccccatattgatctcgccattgatggtgctgatgaagttgaccctaacctcgacttagttaaaggccgtgggggtgcacttttgcgagagaaaatggttgaagcagcttcatcttctttcattgtagtggctgatgatagcaagcttgtttcagggcttggagggagtggtttagccatgcctgttgaagttgtgcaggtgtggtggaatataacttggttagacttgaaggattgttcaaagagttgggttggaaagcagagtggagatagcaagggatggggggggaaaggcttacgggactgatgtgtgaactactgtggggttgggttgggggattgcatagaagatgggttggacagggaaaagagattggggctgggagggggaggggacctggggaggccggggcgaggcgacgaggctgttatcctcggaggacgggtggggaggtggcgagtggtgggggtggtgtgatgggagacgaggtggggtgttgta

SEQ ID NO: 149 - protein, 219 aa, Gossypium arboreum
MASLSFLHLSSATRFTPRATPLNHRARTQKSFSIRSQSAPVLSQDELKKLAADKAVESVKSGMVLGLGTGSTAAFVVDKLGQLLSTGQLSNIVGIPTSKRTQEQAASLNIPLSTLDLHPHIDLAIDGADEVDPNLDLVKGRGGALLREKMVEAASSSFIVVADDSKLVSGLGGSGLAMPVEVVQVWWNITWLDLKDCSKSWVGKQSGDSKGWGGKGLRD

SEQ ID NO: 150 - DNA, 915 bp, Gossypium arboreum
cgaattcactcttttcctcctattaaacaaaagccaatggcctccttatccttcctccacctctcctccgccacccgttttaccccacgcgccactcctcttaaccaccgggctcgaacccagaaatcattctccatcaggtcccaatctgccccagtcctttcccaagatgagctcaaaaagcttgcagctgacaaagcggttgagtcagtcaagtcaggtatggtcctaggcctaggaacaggctcaacagctgcctttgtggttgacaaactgggtcaactcctttccaccggtcaactttctaacatcgtcggaatcccaacctcaaaaagaacccaagagcaagctgcatcacttaatatccctttatccacccttgacttgcatccccatattgatctcgccattgatggtgctgatgaagttgaccctaacctcgacttagttaaaggccgtgggggtgcacttttgcgagagaaaatggttgaagcagcttcatcttctttcattgtagtggctgatgatagcaagcttgtttcagggcttggagggagtggtttagccatgcctgttgaagttgtgcagttttgttggaaatataacttggttagacttgaaggattgttcaaagagttgggttgtgaagcaaagttgagattagcaggggatggtagtgaaaagccctacgtgactgataatatgaacctacttggggatttgtatttcaggttccaataaagagggtttgccgctgggaagaaaattctgcctggaagggtattggacctggggtggttttaggatggctaaccttgttttattgctggaagaacagggtgaagttttactaatggatggaaaaggaaagggagggggaagtggcttgtgggttttaaatatggagggtatttg

SEQ ID NO: 151 - protein, 234 aa, Gossypium arboreum
MASLSFLHLSSATRFTPRATPLNHRARTQKSFSIRSQSAPVLSQDELKKLAADKAVESVKSGMVLGLGTGSTAAFVVDKLGQLLSTGQLSNIVGIPTSKRTQEQAASLNIPLSTLDLHPHIDLAIDGADEVDPNLDLVKGRGGALLREKMVEAASSSFIVVADDSKLVSGLGGSGLAMPVEVVQFCWKYNLVRLEGLFKELGCEAKLRLAGDGSEKPYVTDNMNLLGDLYFRFQ

SEQ ID NO: 152 - DNA, 1269 bp, Gossypium hirsutum
acgcggggactacacccaaacaatcccttatgcctcatacctcatacctcgctcgcctccccgcccttcttcttcaaagcaaagaaaattcccactcttttctttgctttttctctcactattcatacccttttgacttttttggttgatttagtttttaacttgccaaaatttttaatatattcttctttattgtttgctaccgattaaccccgcccaaataatggctgttgcttggtctgaaaaagcttcttccatggaggctttgtctttgtctcctcctatgtctccgccggttatcctaacccaagacgaattaaaaaaaatcgccgcttacaaagccgttgagttcgtggaatcaggcatggttctgggtctgggcacaggttccacggccaaacacgccgtcgaccggatcggcgagttgcttcgtcaaggcaagctcaccaacatcataggaatccccacctccaaaaaaacacaagaacaagctatttctttaggtatcccactttcggatctcgacagccaccccaccattgatatggcaatcgacggtgctgatgaagtggacccgcatcttaatctggtgaaaggcagaggtgggtctctgttaagagagaaaatggtggaaggagcttgcaagaaatttgtatgtatcgttgatgaatccaagttggtcaagtatttgggaggcagcggtttggctatgcccgtcgaagttgttcctttttgttggaaattcactgccaaaaaactccaaaacttgtttcgagattctggttgcgttgccaagctgaggaatgattgtaaaggggagcctttcgtaacggataatgggaattacattgtggatttgtatttgaagaaagatattggggatttgcaggtggcaagcgatgctattttgaggattgctggtgtggttgagcatggcatgtttcttgatatggccactactgttatagttgcaggtgagcttggaatcaccatcaagaataagtagtacaaactcaaactaactttattttaataattagggaattgctattgcagctgggaatggattcttccttttttggcatctattgattgatgacaagagttgtcttgtcttctcaagttttgttattttcgttttggacacaaatttaagggaagagaagatttagggatgttaggattgtgaaagcagtagttgaactatgagaatgatgaatgtcaactggtctatggtctttttaatcataaaactcggtttattattgc

SEQ ID NO: 153 - protein, 260 aa, Gossypium hirsutum
MAVAWSEKASSMEALSLSPPMSPPVILTQDELKKIAAYKAVEFVESGMVLGLGTGSTAKHAVDRIGELLRQGKLTNIIGIPTSKKTQEQAISLGIPLSDLDSHPTIDMAIDGADEVDPHLNLVKGRGGSLLREKMVEGACKKFVCIVDESKLVKYLGGSGLAMPVEVVPFCWKFTAKKLQNLFRDSGCVAKLRNDCKGEPFVTDNGNYIVDLYLKKDIGDLQVASDAILRIAGVVEHGMFLDMATTVIVAGELGITIKNK

SEQ ID NO: 154 - DNA, 1322 bp, Gossypium hirsutum
cttcaccacataccccctcttcccttatccctttccctgtccctttcctcaccattacgctgttaatccccatcccaatatctgggtttctgaaggaacccctaaaggagaaaggaataataataagaaaccccactctttttcttgccccctttctgactgattcaattttagcctttcgtttcttttgattcaatttatcatctcatttttatttttctttttttaaaaaaatttgaacctattattctttattaaccctcaaaagatggcgattgcttggtctgaaactgctgcttcaatggaggctttatctttgtctccccctatgtccccacccgtcatcctaacccaagacgaattgaaaaaaatcgccgcttacaaagccgttgagttcgttgagtcgggtatggttttgggtctgggcacgggttcgacagccaaacacgccgtggatcgaatcgggaagttgctccggcaaggcaagctcagcaacatcgtaggaattcccacatcgaagaaaacgcaggaacaagctgtttctttgggcatcccactttcagatctcgacaactatcccaccattgatttagccatcgacggggcggatgaagtggacccgcatctcaatctggtgaaagggagaggtgggtcgcttttaagagagaaaatggtggaaggagcatgcaagaaatttgtttgtattgttgacgaatccaaattggttaaacatttgggagggagcggtttggctttgccggttgaaatcgttcccttttgctggaaatttactgcaaataagctccaaaagttgttccaagggtcggattgcgtggccaagctgaggaatgatggtgaagggaagccatttgtgacagataacgggaattacatcgtggatttgtatttgaagaaagaaatgggggatttgcgggttgcaagcgatgctattttgaggattgcgggtgtggttgaacatgggatgtttcttgatatggccaccactgttattgttgcaggtgagcttggaattactatcaaggataagtagaactattgggggcggggggcaattatttctaaccctttttcgtatttactgaattacaactattgctttcagatttaccttttggcatctatattgattgatgatgggaagagaggtcttcactagtaagtttgttgaggcaattaattataattgtaagggaagattgggtttaggaatgttaggattgtgacagcaattgagctatcaattgttatgataattttaatcttacactcaatagtttttccaaattagtccaattcaactc

SEQ ID NO: 155 - protein, 260 aa, Gossypium hirsutum
MAIAWSETAASMEALSLSPPMSPPVILTQDELKKIAAYKAVEFVESGMVLGLGTGSTAKHAVDRIGKLLRQGKLSNIVGIPTSKKTQEQAVSLGIPLSDLDNYPTIDLAIDGADEVDPHLNLVKGRGGSLLREKMVEGACKKFVCIVDESKLVKHLGGSGLALPVEIVPFCWKFTANKLQKLFQGSDCVAKLRNDGEGKPFVTDNGNYIVDLYLKKEMGDLRVASDAILRIAGVVEHGMFLDMATTVIVAGELGITIKDK

SEQ ID NO: 156 - DNA, 1205 bp, Gossypium hirsutum
ggaaaaggccaaaacaagcccccgaattcactcttttcctcccactaaacaaaagccaatggcctccttatccttcctccacctctcctccgccacccgttttaccccccgcgccacccctattaaccaccgggctcgaacccagaaatcattctccatcaggtcccaatctgccccagtcctttcccaagatgagctcaaaaagcttgcagctgacaaagcggttgagtcagtcaagtcaggtatggtcctaggcctaggaacaggctcaacagctgcctttgtggttgacaaactgggtcaactcctttccaccggtcaactttctaacatcgtcggaatcccaacctcaaaaagaacccaagagcaagctgcatcgcttaatatccctttatccacccttgacttgcatccccatattgatctcgccattgatggtgctgatgaagttgaccctaacctcgacttagttaaaggccgtgggggtgcacttttgcgagagaaaatggttgaagcagcttcatcttctttcattgtagtggctgatgatagcaagcttgtttcagggcttggagggagtggtttagccatgcctgttgaagttgtgcagttttgttggaaatataacttggttagacttgaaggattgttcaaagagttgggttgtgaagcaaagttgagattagcaggggatggtagtgaaaagccttacgtgactgataatatgaactacattgtggatttgtatttcaagaatccaataaaagatgggtttgcagctgggaaagagatttctgccatggaaggtgtagtggaacatgggttgtttttagggatggctacctctgttattattgctgggaagacaggtgtggaagttatgactaagtgattgaagaaggcaaaggtgaggtggaagttgtattgttgttatttcatatttgaggggattttgattctgggttttgggggcggggattaatgcaaatgtttcggattttgctgctgtgtactgtagagtaactgaacattgtggaataattgaggattttggaaataaaattgacgaattggttaatggttatgttgtgcttctatacttgcaatggtctatctagtttccctgttctttgggttatttttgaagtttggttggattgatttatgggtttattgaagttgttctttaggtcatttgtgggatg

SEQ ID NO: 157 - protein, 277 aa, Gossypium hirsutum
MASLSFLHLSSATRFTPRATPINHRARTQKSFSIRSQSAPVLSQDELKKLAADKAVESVKSGMVLGLGTGSTAAFVVDKLGQLLSTGQLSNIVGIPTSKRTQEQAASLNIPLSTLDLHPHIDLAIDGADEVDPNLDLVKGRGGALLREKMVEAASSSFIVVADDSKLVSGLGGSGLAMPVEVVQFCWKYNLVRLEGLFKELGCEAKLRLAGDGSEKPYVTDNMNYIVDLYFKNPIKDGFAAGKEISAMEGVVEHGLFLGMATSVIIAGKTGVEVMTK

SEQ ID NO: 158 - DNA, 1015 bp, Gossypium hirsutum
attcaccaaaaaccaatggcttccttatccctcaacctctcctccctccaccacacctccatcaaccctcttatcctacgctgcacccctctgaacctacgcaccccatcccagaaaccattctccattaggtcccaagccgccccagtgctttcccaagatgatcttaaaaagcttgcagctgacaaagcagttgagtcagtcaaatcaggcatgatcctaggcctaggaacaggatcaacagcagcttttgtggtcgacaaaataggccaactcctttccacgggccaactttctaacatcgtaggtatcccaacttcgaaaagaacacaagaacaagctgcatcacttaacatccccttatctacccttgacttgcatccccgtattgaccttgctattgatggtgctgatgaagttgatcctaaccttgacttggttaaaggccgaggcggtgcacttttgcgtgagaaaatagttgaagcagcttcatcttccttcattgtagtagccgatgaaagtaagctagtttcagggcttggagggagtggtctagctatgcctgttgaagttgtgcagttttgctggaaatacaatctaattagactgcaagggctgtttaaagagttaggttgtgaagcaaagttgaggttagtaggggatggtagtgaaaagccttatgtcactgataatgggaattacattgtggatttgtatttcaagaatccaattaaagatgggtttggagctgggaaagagatttctgccttggaaggtgtagtggaacatgggctgtttttaggaatggctacctctgtcatcattgctgggaaaactggtatagaggttatgactaagtgaataagtgttgactggaatttactttctgtgagggggtaatttgttattctgtgtagagtgattgcagaatgttgaatgattgaggggattttagaaaggaattttattggttaatgaatatgtagttttatggttattgctttttcatatttag

SEQ ID NO: 159 - protein, 281 aa, Gossypium hirsutum
MASLSLNLSSLHHTSINPLILRCTPLNLRTPSQKPFSIRSQAAPVLSQDDLKKLAADKAVESVKSGMILGLGTGSTAAFVVDKIGQLLSTGQLSNIVGIPTSKRTQEQAASLNIPLSTLDLHPRIDLAIDGADEVDPNLDLVKGRGGALLREKIVEAASSSFIVVADESKLVSGLGGSGLAMPVEVVQFCWKYNLIRLQGLFKELGCEAKLRLVGDGSEKPYVTDNGNYIVDLYFKNPIKDGFGAGKEISALEGVVEHGLFLGMATSVIIAGKTGIEVMTK

SEQ ID NO: 160 - DNA, 1293 bp, Gossypium hirsutum
ccaccatccattttatttgtgtggcctgggtcttgactttcaggactggatcccctttcctccatccgcctttataactacctaacacacccctttctgttttccatacgcctcctctcctcgcctaaatcaatttcctggagggaaataacaaacgggagacaatcaaatcccactttcttttttcttcttccactttgtattttacaatgctaatcttttgatttctgttgattcattttttttattttttttatcatttattatctgtttttcttattatttagtaccccaataaccccccccccacacaaaatggcaattgcttggtctgaaaaagcttcttttatggaggttttgtctaggcctccttctttatctccaccggtcatcctaacccaagacgaattgaaaaaaattgccgcatacaaagccgttgagttcgttgaatcaggaatggttctgggtctaggcactggttcgacagccaaacacgccgtggatcgcatcggtgagttgcttcgcctcggcaagctcaaaaacatcgtaggaattcccacctccaagaaaacgcaagagcaagctgtttctttaggcatcccgctctcggatctcgaccaccattccaccatcgatttagcaatcgacggcgccgatgaagtggacccacagcttaatctcgtcaaaggcagaggtgggtccctgttaagagagaaaatggtggaagggacttgtaagaaatttatttgtattgttgatgaatccaaattggttaagcatttgggagggagtggcttagccatgcctgttgaagttgtccccttttgctggaaattcacagctaataaactccaaaacctgttcgaagattcaggttgtgtggccaagctgaggaatgattctaaagggaaaccctttgtaacagataatgggaattatattgtggatttgtatttgaagaaagacattggggatttgcaggtggcaagcgatgctattctgaggattgctggtgtcgttgaacatggcatgtttcttgatatggctacgactgttattgttacaggtgagcttgggatcaccatcaagaacaagtagaaactgcgaaaaaaattactcttttaactatttttttttacatatactatttaggatagattttggattgctttttagcatacatcgatttacgatgatgataatgagaaaggttgggtttctcaagttttgctgttttaggcaaatgaggaaaggacttaggatgtatgccaactattatgataatacaaataa

SEQ ID NO: 161 - protein, 260 aa, Gossypium hirsutum
MAIAWSEKASFMEVLSRPPSLSPPVILTQDELKKIAAYKAVEFVESGMVLGLGTGSTAKHAVDRIGELLRLGKLKNIVGIPTSKKTQEQAVSLGIPLSDLDHHSTIDLAIDGADEVDPQLNLVKGRGGSLLREKMVEGTCKKFICIVDESKLVKHLGGSGLAMPVEVVPFCWKFTANKLQNLFEDSGCVAKLRNDSKGKPFVTDNGNYIVDLYLKKDIGDLQVASDAILRIAGVVEHGMFLDMATTVIVTGELGITIKNK

SEQ ID NO: 162 - DNA, 1091 bp, Glycine max
ccgggaggatggaaaaggaatatccacccaactttgtgttgaaagcaaagagataaagtaataaaaaagggccaaacataaagcatcaaacctgggtggggtgtggctctactgttttctcttaccataatcatcaatggcttccttatccctctcctctcccccatctctctcttccgcacaccacaacgcctccacgcgccttattctacgcacccctaactcccttaaactgcgcactccaccccactccctccccgccatccgcgccatcaccctcacccaggacgacctcaagagactcgccgccgacaaggccgtggagtccgtcaagagcggcatggtcctcggcctgggcaccggctccactgctgccttcgtcgtcgccaagcttggcgcccttctcgcctccggccaactctccgacatcgtcggtgtccccacctccaaacgcacggaggagcaggcccgctccctcggcatccccctctccgtcctcgacgacaacccccgcctcgatctcgccatcgacggcgccgacgaggtcgaccccgacctcaacctcgtcaaaggccgcggcggcgccctcctccgcgagaagatggtcgaggccgcctccgacaagttcgtcgtggtcgtcgacgacaccaagctcgtggacggcctcggcggaagcgggctggccatgccggtggaggtggtccagttctgctggaagtacaatctggatcggcttcaggagcttttcaaggaagaaggtgtggaagcaaaattgagattggaggagagtgggaaaccctacgtcaccgataattccaattacatcgtggatttgtacttcaagactccaattagggatgcattggccgcaggcgctgaaatttccgctctggaaggcgtcgtcgagcatggcttgttcctcaacatggccacttctgtcatcatcgctggcaaatctggcgttgaagtcaaggccaagtgagactctgaagtaattcgtttcttcttcttcttctcattcttgtctctgtattatttttgttttcagtggaataataataattattgcgttatttggattttgcaaaaaa

SEQ ID NO: 163 - protein, 281 aa, Glycine max
MASLSLSSPPSLSSAHHNASTRLILRTPNSLKLRTPPHSLPAIRAITLTQDDLKRLAADKAVESVKSGMVLGLGTGSTAAFVVAKLGALLASGQLSDIVGVPTSKRTEEQARSLGIPLSVLDDNPRLDLAIDGADEVDPDLNLVKGRGGALLREKMVEAASDKFVVVVDDTKLVDGLGGSGLAMPVEVVQFCWKYNLDRLQELFKEEGVEAKLRLEESGKPYVTDNSNYIVDLYFKTPIRDALAAGAEISALEGVVEHGLFLNMATSVIIAGKSGVEVKAK

SEQ ID NO: 164 - DNA, 1264 bp, Glycine max
ggcacgagcttacattccattctccaccacacattcaattttaaacctctgggcgtggctagcttcaacctttaacattaacatggccattccctacccccatttcatcgccaccgagaaagccgccatggacgccggcctcctccacccctcctccccctccgtcatcctcacccaagacgatttgaagaaaatcgccgcctacaaggccgtcgagtacgtggagtccggcatgatcctcggcctcggcaccggctccaccgccaagcatgccgtcgaccgcatcggcgagctcctccgccagggcaagctcaaggacatcgtcggaatccccacctccacaaaaacccacgaacaagccctctccctcgggatccccctctccgatctcgacgcccaccccgccatcgatctcgccatcgacggcgccgacgaggtcgaccccttcctcaacctcgtcaagggccgtggcggctccctcctccgagaaaaaatggtcgaaggcgcatgcaagaagttcatcgtcatcgttgatgagtccaagctcgtaaactatttggggggtagtgggttggccatgcccgttgaggttattaagttctgttggaggttcaccgcggcgaggttgcagaagctttttgaggaggctgggtgcgttgccaggctcagaacttttggggagaaggagaaggaggagccttatgtgacggataatgggaactttattgtggatttgtatttcgagaggagtattggggatttgaaggctgctagtgatgctattttgcagcttgctggggttgtggagcatggcatgtttcttgatatggctaccactgttattgttgcaggggagctcgggttgacggtcaagaacaagtagttgttgttggtggttaggagaatgaaggtaggttaattggccaaggttgacatggggtttctaagttctatctaacccatttgtatggtgtagtagtaaaaaaggttttaatccaggggtaaagggggattttgattaaatccttttgttattcaatacagttgttggagaaagtttataagttctccggtagttttgttttgttttttttaggggcggggggatttagtttgagcaagcagaaagcaaaatggagagatgagtattaatctcatgcaatgactgttgtgtggcgttgaatcgattgtccgcacaatttgttgttcatttgacagacagtgtttaacatattgaatctatctatctaattcaatttttcat

SEQ ID NO: 165 - protein, 266 aa, Glycine max
MAIPYPHFIATEKAAMDAGLLHPSSPSVILTQDDLKKIAAYKAVEYVESGMILGLGTGSTAKHAVDRIGELLRQGKLKDIVGIPTSTKTHEQALSLGIPLSDLDAHPAIDLAIDGADEVDPFLNLVKGRGGSLLREKMVEGACKKFIVIVDESKLVNYLGGSGLAMPVEVIKFCWRFTAARLQKLFEEAGCVARLRTFGEKEKEEPYVTDNGNFIVDLYFERSIGDLKAASDAILQLAGVVEHGMFLDMATTVIVAGELGLTVKNK

SEQ ID NO: 166 - DNA, 1179 bp, Oryza sativa
tcctccgctcctttcccgccgccgcctcctatagccacccttccccctacccccaaaaatcccccacctcccaatcccccaaacccctcctccacctccacctccgccatgggcagcttcgcctcccccctcgacgccgcccccgcccctcccaccgccaagccctcccctccgccggcgccggcgccggccaacgggctggtgacccaggaggagctgaagcgggtggcggcgcaccgggccgtggagatggtggagcccgggatgacgctgggcctcggcacgggctccaccgcggcccacgcgctggaccgcctcggcgacctcctccggtccggggagctcgccgcggtggccggcgtcccgacctcgctcaagacggaggcgcacgccgccagggtggggatcccgatgctgccgctcggggaggcgggcgggatcgatctgtccatcgacggcgccgacgaggtcgacccggagctgaacctcgtgaaggggcggggtgggtcgctgctcagggagaagatgatcgaggggtccgggggaaggttcgtcgtcatcgtcgatgagtccaagctcgtcccgcggctcggctgtacgggcgccgtccccgtcgaggttgtccccttcgggtgcgaccacactctgggcctcgtccgcaaggtgttcgacggattgcctggcttcagcgcgaggctcaggacggtcgcctccaaggacggcgaggggaaggaggagatgttcgtcaccgacaacggcaactacatcgtcgagatgttcttcgaggatggcatacgcggcgacctcaacgagatcagcgaccgcctcctacggatcaccggcgtcgtcgagcacggcatgttcctcggcatggccacctcggtggtcgtcgccaagaaggacggcaccgtcgccctgctccacaagaagaagtaaccgccccggcagcggcggcggcgccaccaccgacgccaaaataaaccaagattttgcagcgaagcgagggcagccccagcagctggtgcccctccccaacccaagtatctattgctctctagtatgttgaacttgatgtacgtctctactattaccatgatttctctctttttttcatggtaatgttcttgagtgatgctatcaatggacgaagctaataacttgtggacttttgatccatgg

SEQ ID NO: 167 - protein, 275 aa, Oryza sativa
MGSFASPLDAAPAPPTAKPSPPPAPAPANGLVTQEELKRVAAHRAVEMVEPGMTLGLGTGSTAAHALDRLGDLLRSGELAAVAGVPTSLKTEAHAARVGIPMLPLGEAGGIDLSIDGADEVDPELNLVKGRGGSLLREKMIEGSGGRFVVIVDESKLVPRLGCTGAVPVEVVPFGCDHTLGLVRKVFDGLPGFSARLRTVASKDGEGKEEMFVTDNGNYIVEMFFEDGIRGDLNEISDRLLRITGVVEHGMFLGMATSVVVAKKDGTVALLHKKK

SEQ ID NO: 168 - DNA, 1077 bp, Oryza sativa
atcttcttcttccttccaccaccaaccccccatctcctccatctccactccacctcacacgcctcatcgacctcccaagaaccaccaccgccttctcccatggccgccgccaccgtctccgtccgcttccacccggccgcatccgccgcgcgctgcggcggcggctcgcgccggagcaggcgcctgtccggggtcatcagggcgcagtcggcgccggcttcggcggcggcggcggcgctgacgcaggacgacctgaagaggctggcggcggtgcgcgcggtggagcaggtggagagcgggatggtgctggggctggggaccgggtcgacggcggccttcgccgtcgcggagatcggggcgctgctggcgtccgggaagctgagcggcatcgtcggggtgcccacctccaagcgcacgttcgagcaggcgcagtcgctcggcatcccgctctccaccctcgacgaccacccccgcatcgacctcgccatcgacggcgccgacgaggtcgatccagaccttaaccttgtgaaagggagaggtggtgcccttctccgggagaagatggttgaggcagcatcagacaagttcatcgttgttgttgacgagacaaagctagttaccggcttaggagggagtggtctagccatgcctgtggaggttgtgcagttctgctggaagtacaaccaagtgagattgcaggatctgtttaacgatgaaggatgcgaggcgaagctgagattggatgaaggcggcaaaccctacgttaccgacaactcaaactacatcgttgatttatacttcaagacgccgatcaaggatgcgttggcagcagggaaggagatctcagctttggaaggcgtcgttgagcatgggctgttcctggacatggcgacttcggtgatcatcgctggaacagatggcgtcagtgtcaaaacaaagtgagttttggggttttgttgttgccggtgttgaatttacgattttttgttgggatgtataagctattggggtgtaaaagcaggcaataagatgcttcactaataataattgaatatatttccccactctttcattgct

SEQ ID NO: 169 - protein, 280 aa, Oryza sativa
MAAATVSVRFHPAASAARCGGGSRRSRRLSGVIRAQSAPASAAAAALTQDDLKRLAAVRAVEQVESGMVLGLGTGSTAAFAVAEIGALLASGKLSGIVGVPTSKRTFEQAQSLGIPLSTLDDHPRIDLAIDGADEVDPDLNLVKGRGGALLREKMVEAASDKFIVVVDETKLVTGLGGSGLAMPVEVVQFCWKYNQVRLQDLFNDEGCEAKLRLDEGGKPYVTDNSNYIVDLYFKTPIKDALAAGKEISALEGVVEHGLFLDMATSVIIAGTDGVSVKTK

SEQ ID NO: 170 - DNA, 806 bp, Ostreococcus tauri
atgacgcaggatgaattaaaaaagctcgtcggatataaatccgtggacgatcacgtcgagagcggtatggtggtcggtctcggtacgggatcgacggcgtacttcgcggtcgagcgcgtcgggcaaaagctggcgagcggggagctgaagaatgtgatctgcatcccgacgagcgagcgcacgcgcgagcaggcggaatcgctgaagattccgttgtgcacgctgaacgagaagtcggaactcgatgtcgcgatcgatggcgcggatgaggtggatccggcgttggcgttggtcaagggcggcggcggcgcgctgttgcgcgagaagatggtggaggtgatggcgaagaagtttgtcgtcatcgtcgacgagtccaagctctgcaagggactcggaccgggattcccgttgccggtggagatcacgccgttctgccacatgcacacgctgcgtacgatcgcaaagttgcccgcgctcgcgggttgcgaggccatcctccgcatgggatcctcgtcgaacaacaagatcgacggcgataacatcgcggttacggataacggcaactacatcgtcgacttgcacttcaagtccccgatcaaggatccggtcgcggccgcgagccagctcaagaactgcgtcggcgtcgttgatcacggtttgttcgtcgacatggcttaccaagtcatcgttgcgggcagcgatggcatccgcgtcgccggcacggatggcgagaagccgtggtggtaaaagaatcgcgccgctgacgcctcgtcgaatgccaagtttattaatacgaaataacgatg

SEQ ID NO: 171 - protein, 248 aa, Ostreococus tauri
MTQDELKKLVGYKSVDDHVESGMVVGLGTGSTAYFAVERVGQKLASGELKNVICIPTSERTREQAESLKIPLCTLNEKSELDVAIDGADEVDPALALVKGGGGALLREKMVEVMAKKFVVIVDESKLCKGLGPGFPLPVEITPFCHMHTLRTIAKLPALAGCEAILRMGSSSNNKIDGDNIAVTDNGNYIVDLHFKSPIKDPVAAASQLKNCVGVVDHGLFVDMAYQVIVAGSDGIRVAGTDGEKPWW

SEQ ID NO: 172 - DNA, 762 bp, Physomitrella patens
atgaatgcaattgtgcctgacggatttgcttctgaatcggatgcaggtaccaagcttacacaggatgaactcaagaagattgctgccgagaaggctgtggaatatgtcaagagtggcatggtcttgggtttgggcacaggttctacagctgcatttgcagtggcaaagattggcgagcttttgaaggaaggaaagctgacggatattgttggagtgcctacctcaaagagaacggcagaacaggctgcgtcactgggcatccctctatctgttttggatgatcatcctaagattgatctagctatcgatggagctgatgaagtcgatcccgatctcaaccttgtgaaaggacggggtggtgctttacttcgtgagaagatggtggaggctgcttcagcaaagtttgtagtgattgttgatgaaaccaagttagtgaagggccttggaggcagcaagctggccatgcctgtggaggttgtccagttttgctggaagtataatgccgagcgcttgaagaaccttccagaacttgctggttgcgaggttaaacttcgcatggatggcgacaagccctatgtgactgacaattcgaattacatcatcgacctttacttcgaggagcctattgtagacgccaacgctgcagctcaggctatctccgcattagaaggtgtggtggaccatgggcttttcttgaacatggccagcgctgttatcattgcaggttctgatggtgttactgtccaaactaaggacacttag

SEQ ID NO: 173 - protein, 253 aa, Physcomitrella patens
MNAIVPDGFASESDAGTKLTQDELKKIAAEKAVEYVKSGMVLGLGTGSTAAFAVAKIGELLKEGKLTDIVGVPTSKRTAEQAASLGIPLSVLDDHPKIDLAIDGADEVDPDLNLVKGRGGALLREKMVEAASAKFVVIVDETKLVKGLGGSKLAMPVEVVQFCWKYNAERLKNLPELAGCEVKLRMDGDKPYVTDNSNYIIDLYFEEPIVDANAAAQAISALEGVVDHGLFLNMASAVIIAGSDGVTVQTKDT

SEQ ID NO: 174 - DNA, 1269 bp, Physomitrella patens
aacattgaattgagagctgaattgagatcgaagggaattttcgaaactgctggacattctattccatctctgggcctcatccccctgccctccctccctgatcgagccccccttgcgaaatcgcagttcggcacctggtgcggtagcggcatcagcagcaggcagcaggagcagctatggcgtcgtcggccatgttggcaagtcaagcgcccactggagcgtcgggcgtagcggtggtctcggttccgcgcagttcggtgtcggggtcatcgtcatccactacgcagctttcggtcaagtcgttcggggcgtcgtcgacgttgctgtgcggcggggaagtagtgcagaagcaggccgggttcgggagcgtgccgaagaaatctaacgccatgacgttcgctcctcgtgcgcaatcgcaagctacccaggctcttactcaagatgagctgaagaaaatcgctgctgagaaggcagtggaatatgtcaagagtggcatggttttgggtttgggcacaggctccacagctgcatttgcagttgcgaagattggcgagcttttgaaggaaggaaagttgacggatatcgttggagtgcctacttcaaagagaacggcagaacaggctgcatctctgggtattcctctttctgttttggacgatcatcctaagattgatttggcgatcgatggagccgatgaagtggatcccgatctcaatcttgtgaaggggcgaggtggagctttacttcgtgaaaagatggtggagaaagcatcagcaaagtttgtagtcattgttgacgaaaccaagttggtgaagggacttggaggcagtggattggctatgcctgtggaagttgtccagttttgctggaagtacaacgctgaacgcctgaagaatcttccagaagttgctgggtgtgaggttgaactgcgtatggatggagacaagccgtatgtgactgacaactcgaactacatcatcgatctttatttccaggagcccattaaagatgccaatgctgcagctcacgcaatttctgcactagaaggtgtggtagatcatggtcttttcttgaacatggccagcgcagttatcattgcaggctctgatggagtaactgttcaaaccaaggatacataggtatttagagaggacaactcgttaatgtttcacttatttagattgactgttgtacgcttcctaatgaaactgctgcaacaaggcggattctctaaatacaactattttgtagacacctctgttttctgac

SEQ ID NO: 175 - protein, 320 aa, Physcomitrella patens
MASSAMLASQAPTGASGVAVVSVPRSSVSGSSSSTTQLSVKSFGASSTLLCGGEVVQKQAGFGSVPKKSNAMTFAPRAQSQATQALTQDELKKIAAEKAVEYVKSGMVLGLGTGSTAAFAVAKIGELLKEGKLTDIVGVPTSKRTAEQAASLGIPLSVLDDHPKIDLAIDGADEVDPDLNLVKGRGGALLREKMVEKASAKFVVIVDETKLVKGLGGSGLAMPVEVVQFCWKYNAERLKNLPEVAGCEVELRMDGDKPYVTDNSNYIIDLYFQEPIKDANAAAHAISALEGVVDHGLFLNMASAVIIAGSDGVTVQTKDT

SEQ ID NO: 176 - DNA, 983 bp, Populus trichocarpa
catccccataccaaaaaaaaaaaacccaccatggcttcgttatccttgctcccctctccttcctcctcctcctcctcctctctttcctccctccaccacaccaccccttcctcatcccgcctcaccctatgcaccccgtcccttaacgtccgcacccgcaccaaaatctcctccatcaaagcccaatccgctccagtcctcacccaggacgaccttaaaaaacttgctgccgacaaagccgtagagtatgtcaaatccggcatggtcctcggccttggtaccggctccaccgccgccttcgtggtagccaaactcggcgagctcttaaagaccggggaactgaaagacatcattggagtcccaacttctaaacgcacagaagaacaagctcgttctcttaacattcccctttcggtcctggatgaccatccccacattgatcttgccattgatggagctgatgaggtagacccacttcttaatttagtaaagggtcggggtggagcccttttgagagagaaaatggttgaagctgcatcggatgagtttgttgttgtcgctgatgacactaaggttgtggatggtcttggtggaagtaagctggcaatgccagttgaagtagtgcaattttgttggaaatataacttgttgaggttacaagaaatgtttaaagatgaaggggttgaggctaaattgagagctggtgaagatgggaagccttatgtgaccgataattttaactatattgttgatttgtactttgagaatcccattaaagatgggtatgccgcggggaaggagatttcggggcttgaaggtgtcgtggaacatggtttgtttttggatatggcgaccgcggttattattgctgggaagacaggagttgaggttaaaagcaagtgaggatttctaatctttatgttatttgatgctttgttacattgacattggtgttgttcattatttttgttgcggtgaatttg

SEQ ID NO: 177 - protein, 303 aa, Populus trichocarpa
MASLSLLPSPSSSSSSSLSSLHHTTPSSSRLTLCTPSLNVRTRTKISSIKAQSAPVLTQDDLKKLAADKAVEYVKSGMVLGLGTGSTAAFVVAKLGELLKTGELKDIIGVPTSKRTEEQARSLNIPLSVLDDHPHIDLAIDGADEVDPLLNLVKGRGGALLREKMVEAASDEFVVVADDTKVVDGLGGSKLAMPVEVVQFCWKYNLLRLQEMFKDEGVEAKLRAGEDGKPYVTDNFNYIVDLYFENPIKDGYAAGKEISGLEGVVEHGLFLDMATAVIIAGKTGVEVKSKGFLIFMLFDALLH

SEQ ID NO: 178 - DNA, 926 bp, Populus trichocarpa
tttttaagagaaggaaagaaaccaagaaacatggccattccttatcatcatttcaatcttgttacttctgagaaaccagatatggagatgctttttccatctcctgtggttttgacccaagatgagcttaaaagaatagcagcttacaaagctgtggagatggtggaatcaggcatggttgtcggtcttggtactggttcaacagcgaagcatgctgtggatagaattggggagcttttgcatcaagggaagttgaaaaacattataggtatacctacttcaacaaaaacacatgaacaagctttgtctttaggtattcctttgtcagatcttgattcacaccctgttcttgatattgcaattgatggggctgatgagattgatccaaatcttaatttagttaaaggtagaggtgggtctttgctgagagagaaaatggtggagggtgtttgtaagaagttcgtggttattgttgacgagtctaaattggttaagtatattgggggtagtggtttggctatgcctgttgagattgtgcctttttgttggaaatttactgctaagaggttgcaggaattgtttgaatatgcaggttgtgtggcaaagttgaggacttttgctagttgtaatggaatggagaatggtgggttgccctttgttactgataatgggaattatgttgtggatttgtattttaagagagatattggggatttgaaggctgcaagtgatgcaattttgaggttagctggcgtggttgagcatggaatgtttcttgatatggcgactactgttattgttgcaggggaccttggggtcaccatcaagaataagattataaagtagttagagattcatgtaggagttaatttatcatttttgaagatgtcggcaagacgagtactgttgctgttcattgtttccat

SEQ ID NO: 179 - protein, 271 aa, Populus trichocarpa
MAIPYHHFNLVTSEKPDMEMLFPSPVVLTQDELKRIAAYKAVEMVESGMVVGLGTGSTAKHAVDRIGELLHQGKLKNIIGIPTSTKTHEQALSLGIPLSDLDSHPVLDIAIDGADEIDPNLNLVKGRGGSLLREKMVEGVCKKFVVIVDESKLVKYIGGSGLAMPVEIVPFCWKFTAKRLQELFEYAGCVAKLRTFASCNGMENGGLPFVTDNGNYVVDLYFKRDIGDLKAASDAILRLAGVVEHGMFLDMATTVIVAGDLGVTIKNKIIK

SEQ ID NO: 180 - DNA, 905 bp, Populus trichocarpa
atcaaattacttttgaaaaaacaaaacaaaatggctataccttgtccaccctttattggatcagaaaagctatctatagagtcaggagctatgtctccttcatctccttccccgttaatcctaacccaagacgagctcaaaaaaatcgccgcctataaagccgtcgagtttgtccaatctggcatggtcctcggcttaggcactggctctaccgctaaacacgccgtcgaccgtatcgccgatctcttacaccaaggaaaattaaagaacattataggaatacctacctccacaaaaacccaccaacaagccgtgtctcttggcatccctttatccgatcttgattcgcatcccgtcgttgatcttgccatcgacggtgctgatgaggtggactcgaatctcaatttggtcaaggggcgtggtggatctttgctcagagagaagatgattgagagtgcctgcaagaagttcattgttattgttgaccagtctaagttggtggctcatgttggtgctagtggtgctatgcccgttgaagttgtgccgttttgttggaaattttctcaagataggctgcaaaatttgttcgattacgcggggtgcgttgccaaattgaggaccgataatgggggcgaaaagatttttgttactgataatgggaattatatcgtggatttgttttttaagaaggatattggggatttaaaggttgctagtgatgctattttgaggctagctggggttgttgagcatgggatgtttcttgatatggcaaccactgttattgttgcaggtgagcttgggatcactatcaaggataagtagattgggatttagaagatggagatttttttacaaatttgaaattttttaatgggggcattaatcaagttcgggaattcgac

SEQ ID NO: 181 - protein, 264 aa, Populus trichocarpa
MAIPCPPFIGSEKLSIESGAMSPSSPSPLILTQDELKKIAAYKAVEFVQSGMVLGLGTGSTAKHAVDRIADLLHQGKLKNIIGIPTSTKTHQQAVSLGIPLSDLDSHPVVDLAIDGADEVDSNLNLVKGRGGSLLREKMIESACKKFIVIVDQSKLVAHVGASGAMPVEVVPFCWKFSQDRLQNLFDYAGCVAKLRTDNGGEKIFVTDNGNYIVDLFFKKDIGDLKVASDAILRLAGVVEHGMFLDMATTVIVAGELGITIKDK

SEQ ID NO: 182 - DNA, 908 bp, Populus trichocarpa
taaacaatttttatttttttttctttccaaatggctatcccctgtccatctatttttggatcagaaatggtacccattgagtcaggagccatgtctcctcctccttccccattaattctaacccaagacgagctcaaaaaaatcgccgcctacaaagccgtcgagtttgtccaatccggtatggtcctcggcctaggcaccggctccactgccaaacacgccgtcgaccgtatcgccgatctcctacaccaaggcaaattgaagaacattataggcatacccacctctaaaaaaacccaccagcaagccgtgtcccttggcatccctttatccgatctcgattcgcatcccatcgttgatcttgcaatagacggtgctgatgaggtggactcgaatctcaatttggttaaggggcgtggtgggtctttgcttagagagaaaatgatcgagagtgcttgcaagaagtttattgttattgttgacgagtctaaattggtgcctcatgttggtgcttgtggtgccatgcctgttgaagttgtgccattttgttggaaatttactcaagataagctacaaagtttgtttgattacgcggggtgtgttgcgaaattgaggtctaataatgggggtgaagatggcgagatttttgttactgataatgggaactatatcgtggatttgtttttcaagaaggatgtcggggatttaaagattgctagtgatgctattctgaggctagctggggctgtggagcatggaatgtttcttgatatggcaactactgttatagttgcaggcgagcttggaatcactatcaagaataagtagattgagatttagaagatgggtgtttcacaaatttgaaatttttgatggggtactaatcaagttggaaaatttgactgctt

SEQ ID NO: 183 - protein, 265 aa, Populus trichocarpa
MAIPCPSIFGSEMVPIESGAMSPPPSPLILTQDELKKIAAYKAVEFVQSGMVLGLGTGSTAKHAVDRIADLLHQGKLKNIIGIPTSKKTHQQAVSLGIPLSDLDSHPIVDLAIDGADEVDSNLNLVKGRGGSLLREKMIESACKKFIVIVDESKLVPHVGACGAMPVEVVPFCWKFTQDKLQSLFDYAGCVAKLRSNNGGEDGEIFVTDNGNYIVDLFFKKDVGDLKIASDAILRLAGAVEHGMFLDMATTVIVAGELGITIKNK

SEQ ID NO: 184 - DNA, 974 bp, Populus trichocarpa
ttcccaatccctctaccaccaccacctaccatggcctccttatccttcctctcccctccttcctcctcctctctttcctccctccacaacaccaccccttcctcctcccgcctcttcttacgcacaccctcccttaacctccgcgccccaaccaaaatcttctcccttaaagcccaatccgccccagtcctcacccaagacgaacttaaaaagatcgcagccgacaaagccgtcgagtatgtcaaatccggcatggtcctcggccttggaaccggctctaccgccgccttcgtggtagccaaactcggcgagctcttaaaaaccggtgaactgacaaatatcattggagtcccaacttcaaaacgcacagaagaacaggctcgttctcttaacatccctctttcaatactcgatgaccacccccacattgatcttgccattgacggggctgatgaggtggacccactacttaatttagtgaagggtcgcggcggagcccttttaagagagaaaatggttgaagcagcatcagatgagtttgttgttgttgctgatgagactaagcttgttgatggtcttggtggaagtaaactggcaatgccagttgaagtagtgcaattttgttggaaatttaatttggtgaggttacaagagttgtttaaagatgaaggggttgaggctaaattgagagttggtgaagatgggaagccctatgtgaccgataattttaattatattgttgatttgtattttgagaatccgattaaagatggatatgcggccggaaaggagatttcggggcttgaaggtgttgtggaacatgggttgtttttggatatggcgaccgcggttattattgctgggaagactggagttgaggttaaaagcaagtgagaatttcgaatcttgtgttatatgatggttttgttatattaacactgttgttgttcgttatttttgttgcggtgaatttg

SEQ ID NO: 185 - protein, 287 aa, Populus trichocarpa
MASLSFLSPPSSSSLSSLHNTTPSSSRLFLRTPSLNLRAPTKIFSLKAQSAPVLTQDELKKIAADKAVEYVKSGMVLGLGTGSTAAFVVAKLGELLKTGELTNIIGVPTSKRTEEQARSLNIPLSILDDHPHIDLAIDGADEVDPLLNLVKGRGGALLREKMVEAASDEFVVVADETKLVDGLGGSKLAMPVEVVQFCWKFNLVRLQELFKDEGVEAKLRVGEDGKPYVTDNFNYIVDLYFENPIKDGYAAGKEISGLEGVVEHGLFLDMATAVIIAGKTGVEVKSK

SEQ ID NO: 186 - DNA, 1210 bp, Solanum lycopersicum
catcaccaaccattcaccacccactcccacctatgtccttattttaatttttaggccaagaccaaacaaaaccaagaaaggatcgaccaaaaaattcatcaccccccatggcttcgttatccctaatctcacctcactctccttcttcttcttcttcttctactctccgtcacagttccattattggcacccgtcttccttccatcttcttgcgcaaccccactatccgcattcgctccacaaccccttcaattaaagccttctctgcacccgttccttcacctttaacccaagatgaacttaagaaactagcagccgataaggccgttgagtatgtcaaaagtggaatggtccttggtttaggcactgggtcaacagcagctttcgttgtcgctaaattgggtgagcttctttcatcgggccaactcacgaacattgtaggagttcccacttcaaagcgtactgaagaacaagctttgtcgcttaacatcccgttatctacacttgacgaccacccacatattgatcttgctattgatggtgctgatgaggtcgacccgaatctcgacctagtcaagggtcgaggaggagctcttttaagggagaagatggtggaggccgcgtctgataagtttgttgttgtggtcgatgattcgaagcttgtttcgggtcttggtggatccgggttggctatgccggttgaggtcgtgcagttttgttggaagtacaatttggttaggttacaggaattgtttaaggaagagggtgttgatgcaaagttgagattggatggtaatgggaagccatatgtgaccgataactcgaattatattgtggatttgtatttcaagactcctattagggattctgctgctgctgggaaggagattgcgtctttcgaaggggtggtggagcatggattgttcttggatatgaccactgctgttatcattgctgggaaggaaggtgtcagtgtcaagagcaagtgaaatattcaccaattttagctcccaactggtgaggtctgaacaactttaacttctgttttgagtggaatttttagacttcattttcgtatcgaggaaataggagttgattgttgtaacattaataagtttttgcattttttttggagatgtttagcaataatactcccgtctgaatgtaatttgtatattagaatcgaaaagaaatgtcttttgatgatttc

SEQ ID NO: 187 - protein, 293 aa, Solanum lycopersicum
MASLSLISPHSPSSSSSSTLRHSSIIGTRLPSIFLRNPTIRIRSTTPSIKAFSAPVPSPLTQDELKKLAADKAVEYVKSGMVLGLGTGSTAAFVVAKLGELLSSGQLTNIVGVPTSKRTEEQALSLNIPLSTLDDHPHIDLAIDGADEVDPNLDLVKGRGGALLREKMVEAASDKFVVVVDDSKLVSGLGGSGLAMPVEVVQFCWKYNLVRLQELFKEEGVDAKLRLDGNGKPYVTDNSNYIVDLYFKTPIRDSAAAGKEIASFEGVVEHGLFLDMTTAVIIAGKEGVSVKSK

SEQ ID NO: 188 - DNA, 1382 bp, Solanum lycopersicum
ggtttattgcttcaaggattctgtcacacctctttctcccccgacaaatccttcactttccttcttttcctctcaatttccctataaattctccataaaccctaataaaccaaacgccaaataacattatcttctcccattccacaagttccaatcttgataatcatttttttcttttctttttacagaataaagaaacaccctttattcagattcctctgtttcttgatttttcatctatatatatatatatatatatatatatatatatagtctaatggtttcaatcttcaatttactcaaacccctttaacatttttatgctaaagattcaatctttatcttgaaatttttgatatttccttaattgttgtgttgtttttagcaatggctgttgcataccctcaattttttgggacaaagaaagttgacacttcattgatggtgtcatcatcttcctctgtttcccctgttattttatctcaagatgagttgaaaaagatagctgcttataaagctgtggagtttgtggagtctggtatggttgttggtttaggtacagggtcaacagcaaagcatgctgttgataaaatagctgagcttttacatagtggtaagttaaagaacattgtagggattcccacttcaaagattactcatgaacaagctgtttcacttggtatccctttatcagatctgaataaacatcctattgttgatttagctattgatggtgctgatgaagttgaccctcaaatgaatttggttaaagggagaggagggtcattgcttagggagaaaatggttgaggctgctactaagaagtttattgttattgttgatgagtcaaaattggtgaattacataggtggtagtggacttgctatgcctgttgagattgttcccttttgttgggagtttacattgaagaggcttgagatgttgtttattcaagctggatgtgttggaaagttgagaacaacaggtgcaggtgaagatgaagagccttatgttactgataatggtaattatattattgatttgtatttcaagaaggatatgggtgatttgaaagatgcaagtgatgcaattttgagacttgctggtgttgttgagcatggcatgtttattgatatggctactactgtgattgttgctggaaaacttggtgtctctgtgactaataagttatagggagaaggtttcaattttgattagttgttaccttttaggagccttagctgaggtattaggatgttgggggtgggggatgggggtcttgctaaaacatttatgtggcaagtataaaatcttggtgttttctgccccaattaataaattgaattgtttggggaatttgcctcaaagttgctatcttgctg

SEQ ID NO: 189 - protein, 268 aa, Solanum lycopersicum
MAVAYPQFFGTKKVDTSLMVSSSSSVSPVILSQDELKKIAAYKAVEFVESGMVVGLGTGSTAKHAVDKIAELLHSGKLKNIVGIPTSKITHEQAVSLGIPLSDLNKHPIVDLAIDGADEVDPQMNLVKGRGGSLLREKMVEAATKKFIVIVDESKLVNYIGGSGLAMPVEIVPFCWEFTLKRLEMLFIQAGCVGKLRTTGAGEDEEPYVTDNGNYIIDLYFKKDMGDLKDASDAILRLAGVVEHGMFIDMATTVIVAGKLGVSVTNKL

SEQ ID NO: 190 - DNA, 1172 bp, Saccharum officinarum
cccccgcctcccgttgccaaatcccaatcccctcccttccaagaaccccgcgccgcctccctcctccccacctcgccatgggcagcgccgccgcctcgccgccgccgtcggggaagctgacgcaggacgagctgaagcgcgtggcggcgcaccgcgcggtggagttcgtggagcccggcatgacgctgggcctgggcacggggtccacggcggcgcacgcgctggaccgcctgggcgacctcctccgcgcgggcgcgctcccgggcgtcgccggcgtgcccacctccctcaagacggaggcccacgcgtccgccgtcgggatcccgctgctcccgctcgacgccgcctcgggcgccaggatcgcgctctccatcgacggcgccgacgaggtcgacccggacctcaacctcgtcaagggccgcggcgggtccctgctccgcgaaaagatgatcgagggcgccggggaacgattcgtcgtcatcgtcgacgagtccaagctcgtcccccgccttggatgcacgggcgccatccccgtcgaggtcatccccttcggcgcgccccacacgctgggactcatccgcagcctgttcgacggcttgcctggattccacgccaggctcaggaccgtccccgccgccaaggggggcgacggctcggagcagcccttcgtcactgacaacggcaactatatcgtcgagatgttcttcgaggacggcatccgtggcgacctgcgcgacatcagcgaccgcctgctccggatcaccggcgtcgtcgagcacggcatgttcctgggcatggccaccaccgtcatcgtcgccaacaaggacggcaccgtcgcagtcatgggcaggaagaagtagtagtttacaagtagtaacctgttcctcgaagcagcaatcgcctgctctggatcaacggcgtcgtcgagcatggcagcatgttccttgacgtggccaatcgtcgccaacaacgacgacaagtaataattttgcaactagcctgtgtctgcgcaacatccagctactcttatctaagttggagttgtatcgtgtcgtcctcctatacttgagtgtctgctgattactatggagtatgttaatcatcatcctgatgttatcatccaccttgttaccagggaatctcatgatcttttgctaattttggattcggtt

SEQ ID NO: 191 - protein, 260 aa, Saccharum officinarum
MGSAAASPPPSGKLTQDELKRVAAHRAVEFVEPGMTLGLGTGSTAAHALDRLGDLLRAGALPGVAGVPTSLKTEAHASAVGIPLLPLDAASGARIALSIDGADEVDPDLNLVKGRGGSLLREKMIEGAGERFVVIVDESKLVPRLGCTGAIPVEVIPFGAPHTLGLIRSLFDGLPGFHARLRTVPAAKGGDGSEQPFVTDNGNYIVEMFFEDGIRGDLRDISDRLLRITGVVEHGMFLGMATTVIVANKDGTVAVMGRKK

SEQ ID NO: 192 - DNA, 1048 bp, Saccharum officinarum
atcctcacctcacctccccgagctgcagcacctcccgccaacccacacgcgtccgcccccatggccgccgccaccgcgatctcagtccggctccaccccaccgcggcgagccatgtcgcctcctccgcccgccgccgcgcccggctcgggtccgtccgcgcgcagtccgcgccggcggcggcggcggcgctgacgcaggacgacctcaagcggctggcggccgtgcgcgccgtcgagcaggtgcagagcgggatggtgctcgggctcgggacgggctccacggccgccttcgccgtcgccgagatcggcgcgctcctggccgctggcaagctcgagaagatcgttggtgtgcccacctccaagcgcaccttcgagcaggcgcagtcgctcggcatcccgctctccacccttgacgaccaccccagcatcgacctcgccatcgacggtgccgacgaggttgaccctgacctgaaccttgtgaaagggcggggtggtgctcttcttcgtgagaagatggttgaggcagcatcggccaagtttatcgttgttgttgacgagacaaaactagtggacggattaggaggtagtggtctagccatgccagtggaagttgtgcagttctgctggaagtacaacctagtaagattgcaggaactgtttaaggaggaaggagtcgaggcaaagctaaggtttgaaggcgacaagccctatgttaccgacaactcaaactacattgtcgatctatacttcaagacgccaatcaaggatgcattggcagcagggcaggaaattgcagctttggaaggagttgttgaccatgggctgttcttgaacatggcgagttcagtgatcattgctggaacggacggtgtcagtgtcaaaacgaagtgagtttttgagatactttgctgttgtgttgaattttacgatttaatgtataagctattggtgtaaaagcaggtaataagatgcttcaataaatgtgttcccccaatgtgaggattgactgtcactctattgtgggataaaaaggcatcttactaggttg

SEQ ID NO: 193 - protein, 276 aa, Saccharum officinarum
MAAATAISVRLHPTAASHVASSARRRARLGSVRAQSAPAAAAALTQDDLKRLAAVRAVEQVQSGMVLGLGTGSTAAFAVAEIGALLAAGKLEKIVGVPTSKRTFEQAQSLGIPLSTLDDHPSIDLAIDGADEVDPDLNLVKGRGGALLREKMVEAASAKFIVVVDETKLVDGLGGSGLAMPVEVVQFCWKYNLVRLQELFKEEGVEAKLRFEGDKPYVTDNSNYIVDLYFKTPIKDALAAGQEIAALEGVVDHGLFLNMASSVIIAGTDGVSVKTK

SEQ ID NO: 194 - DNA, 915 bp, Saccharum officinarum
ccaagcgttctgcacacactgcggctgtggatacgcgcgccgccaccgccccttaccatgggcagcgccgccgccgcgtcgccaccgccgccgtcaggcaatctgacgcaggacgagctgaagcgcgtagcggcgcaccgcgcggtggagttcgtggagcccggcatgacgctgggcctgggcacgggctccacggcggcgcacgcgctggaccgcctgggcgacctcatccgcgcgggcgcgctccccggggtcgccggcgtgcccacctccctcaagacggaggcccacgcgacccgcgtcgggatcccgctgctcccgctcgaggacgccgccgcctcggccacgggcgccggcggcatccgcctctccatcgacggcgccgacgaggtcgacccggacctcaacctcgtcaagggccgcggcgggtcgctgctccgggagaagatggtcgagggcgccggggagcggttcatcgtcatcgtcgacgagtccaagctcgtgcccaggctcggctgcacgggcgccgtccccgtcgaggtcatccccttcggcgcgccccacacgctcggcctcatccgcaaggtgttcgacggagtgcccggcttccacgccaggctcaggacggtccccgccgccaagggggagtgctcggacgcgccgttcctcactgacaacggcaactacattgtggagatgttcttcgaggacggtatccgcggcgacctgggggacatcagcgaccgcctgctccggatcaccggcgttgttgagcacgggatgtttcttggcatggccactacccttatcgtcgccaacaaggacgggaccgtcacagtcatgaacaagaagaagtagtaatctccatgtagcctgtctggatgtgtggcgatcgtgtcctggggtgatccaagt

SEQ ID NO: 195 - protein, 266 aa, Saccharum officinarum
MGSAAAASPPPPSGNLTQDELKRVAAHRAVEFVEPGMTLGLGTGSTAAHALDRLGDLIRAGALPGVAGVPTSLKTEAHATRVGIPLLPLEDAAASATGAGGIRLSIDGADEVDPDLNLVKGRGGSLLREKMVEGAGERFIVIVDESKLVPRLGCTGAVPVEVIPFGAPHTLGLIRKVFDGVPGFHARLRTVPAAKGECSDAPFLTDNGNYIVEMFFEDGIRGDLGDISDRLLRITGVVEHGMFLGMATTLIVANKDGTVTVMNKKK

SEQ ID NO: 196 - DNA, 1049 bp, Triticum aestivum
  misc_feature (65)..(65): n is a, c, g, or t
cccgtgttgtgtcccgttcccccgaccaatcccctgccagaaaaccctgggccccattggcctgnggggcaatggacgaggcggcttcgccccggggggcctgtaaggggggaaccacgaagacctccagggcttttccggggcacgggccgattgacatgtgggagtccggcataaccctggggctcggcaccggctcccggccgcgcaacgcgtttgacccccttcgggcccctccttcgaaccgggcgcgttgcgcacggtccccggggtgcccacctccctccaagacgaggccccaccccgcgcggttcgggatccccatgctcgcgctcgccgacgccgccgagatccacctctccatcgacggcgccgacgaggtcgacccggacctcaacctcgtcaaggggcgcggcggctcgctcctccgcgagaagatgatcgagggcgccggcgcccgcttcgtcgtcatcgtcgacgagtccaagctcgtcccccgcctcggctgcacgggctccgtgcccgtcgaggtcgtccccttcggcagcgcctacacgctcggcctcatccgcatggtgttcgacaaattgccgggcttccacgccaggctcaggaccgtcaagtccaaggccggcgacggccaggaggagctctttctcaccgacaacggcaaccacatcgtcgagatgttcttcgaggacggcatacacggcaacctgcgcgacataagcgacagcctgctgcgcatcacgggcgtcgtcgagcacggcatgttcctcggcatggccaccaaggtgatcctcccccaccaggacggcaccgtggcggtcctcagcaagaagtagcctggccgcctggggaagagtctgcagaggagatgacaataagcccagattcaagctgttcttgctcctgcggtgaacttgctctacgttactgttacagcgttttctcctattcatgggtaatccgatggtgcccagcttaatgtggtgaagctaaccaaccttggacttcgccaaattatcttagcaagtcagttttgttcg

SEQ ID NO: 197 - protein, 257 aa, Triticum aestivum
MDEAASPRGACKGGTTKTSRAFPGHGPIDMWESGITLGLGTGSRPRNAFDPLRAPPSNRARCARSPGCPPPSKTRPHPARFGIPMLALADAAEIHLSIDGADEVDPDLNLVKGRGGSLLREKMIEGAGARFVVIVDESKLVPRLGCTGSVPVEVVPFGSAYTLGLIRMVFDKLPGFHARLRTVKSKAGDGQEELFLTDNGNHIVEMFFEDGIHGNLRDISDSLLRITGVVEHGMFLGMATKVILPHQDGTVAVLSKK

SEQ ID NO: 198 - DNA, 946 bp, Zea mays
cgcgcgccgccactccaaggtccaagcctcccttgctcccgccaccgcccctcaccatgggcagcgccgccgcctctccgcagccgtctgggaatctgacgcaggacgagctcaagcgcgtggcggcgcaccgcgcggtggagttcgtggagtccggcatgacgctgggcctgggcacgggttccacggccgcgcacgcgctggaccgcctgggcgacctcctccgcgcgggcgcgctgcccggggtcgccggcgttcccacctccctcaagacggaggcccacgccgcccgcgtcgggatcccgctgcttccgctcgacgccgcctcgggcgccagcatccgcctctccatcgacggcgccgacgaggtcgacccggacctcaacctcgtcaagggccgcggcgggtcgctgctccgggagaagatgatcgagggcgccggcgatcggttcgtcgtcatcgtcgacgagtccaagctcgtgccgaggctcggctgcacgggcgccgtccccgtcgaggtcatccccttcggcgcgccccacacgctcggcctcatccgcaaggtgttcgatggagtgcctggcttccacgccaggctgaggacggtccccgccgccaatggggaggactcggacgcgccgttcctcaccgacaacggcaactacatcgtggagatgttcttcgaggacggtatccgcggcgacctgctggacatcagcgatcgtctgctccggatcaccggcgtcatcgagcatggcatgtttcttggcatggccactacagtcatcgtcgctaacaaggacggcaccgtcacagtcatcaacaagaagaagatgaatcaagccgtgagctcaacttcaacgcgtggaagaggaaaagtgaaagggtgtggacttatttgaggatgaagcattgttgaaagcactctttgagctatcccttgatc

SEQ ID NO: 199 - protein, 281 aa, Zea mays
MGSAAASPQPSGNLTQDELKRVAAHRAVEFVESGMTLGLGTGSTAAHALDRLGDLLRAGALPGVAGVPTSLKTEAHAARVGIPLLPLDAASGASIRLSIDGADEVDPDLNLVKGRGGSLLREKMIEGAGDRFVVIVDESKLVPRLGCTGAVPVEVIPFGAPHTLGLIRKVFDGVPGFHARLRTVPAANGEDSDAPFLTDNGNYIVEMFFEDGIRGDLLDISDRLLRITGVIEHGMFLGMATTVIVANKDGTVTVINKKKMNQAVSSTSTRGRGKVKGCGLI

SEQ ID NO: 200 - DNA, 1488 bp, Zea mays
tccctatccctgcgctgcccacctcccctttcccgcctggccctcccattcacttgcccccttttttccctctcccgacctcccaattcccgaaatcacccccgacactccccacccaagaacccctcgtccccacctcgccatgggcagcgccgccgcctcgccgccgccgtccgggaagctgacgcaggaagagctgaagcgcgtggcggcgcaccgcgcggtggagttcgtggagcccggcatgacgctgggcctgggcacgggctccacggcggcgcacgcgctggaccgcctgggcgacctcctccgcgcgggcgcgctgccgggggtggccggcgtgcccacctccctcaagacggaggcccacgcggcgcgcgccgggatcccgctgctcccgctcccgggcgccaggatcgcgctctccatcgacggcgccgacgaggtcgacccggacctcaacctcgtcaagggccgcggcggctcgctgctccgcgagaagatgatcgagggcgccggcgcccgcttcgtcgtcatcgtcgacgagtccaagctcgtgccgcgcctcggctgcacgggcgccatccccgtcgaggtcatccccttcggcgcgctccacacgctgggcctcatccgcggcctcttcgacggattgcctggattccacgccaggctgaggactgtccccgccgctcccgccaaggggggagaagactcggactcggagtcggagcagcccttcgtcaccgacaacggcaactacatcgtcgagatgttcttcgaggacggcatccgcggcgacctgcgcgacatcagtgaccgcctgctccggatcaccggcgtcgtagagcacggcatgttcctgggcatggccaccaccgtcatcgtcgccaacaaggacggcacggtgtcagtcatggacaggaagaagtagcagtagtaatctacaagcagtagcctgttcttcgaaacagcgatcgcctgatcaccggcatgttccttgacgtggccaccaccaccatcgtcgctgccaacagcgacgacaagaagtactaataattttgcaagtagcctgtgtctgtgcaacacccagctactcttatttaagttggagttgtatcgtgtccgtgcgttatcctcatatgctgagtgtctgcaggagtatgttaatcatcatcctggtgttattatcgtaccttgctaccagtgactctcatgctatttattaaacaagctaattttgcaatcgtattggaatcaccggattgcaattgctgttgcttggaacagtttttaattttagttgagattcacgatcttgatggttttacacataccctacctaaatgagtaagcttagttgagaatcactggattacatatattttcgccataagctgttctgtttcggtaggtttggtttctttcccactactgtccaattgttatgtactcaaatcagttacttctctctatctgtccatgctg

SEQ ID NO: 201 - protein, 263 aa, Zea mays
MGSAAASPPPSGKLTQEELKRVAAHRAVEFVEPGMTLGLGTGSTAAHALDRLGDLLRAGALPGVAGVPTSLKTEAHAARAGIPLLPLPGARIALSIDGADEVDPDLNLVKGRGGSLLREKMIEGAGARFVVIVDESKLVPRLGCTGAIPVEVIPFGALHTLGLIRGLFDGLPGFHARLRTVPAAPAKGGEDSDSESEQPFVTDNGNYIVEMFFEDGIRGDLRDISDRLLRITGVVEHGMFLGMATTVIVANKDGTVSVMDRKK

SEQ ID NO: 202 - DNA, 1159 bp, Zea mays
gtcaagacatcagaatgctcgaatattttttatgaatcaacagaagtttcaacctattaaaatggcttttttatcccacaataagtgatagtcaatccccacattgggggaacacctttattgaagcatcttatcagctgcttttacaccaatagcttgtacattaaattgtaaaactcaacacaaacaacaaagcaactcaaaaactcacttcgttttgacactgacaccgtccgttccagcaatgatcactgaactcgccatgttcaagaacaacccatggtcaacaactccttccagagctgcaatttcctgtcctgctgccaacgcatccttgattggcgtcttgaagtataaatcgacgatgtagtttgagttgtcagtaacatagggcttgtcgccttcaaaccttagctttgcctcgactccttcctccttaaacagttcctgcaatcttacaaggttgtacttccagcagaactgcacaacttccactggcatggctagaccactacctcctaacccatcaactagttttgtctcgtcaacaataacaataaacttgtccgatgctgcctcaaccatcttctcacgaagaagagcaccaccccgccctttcacaaggttgaggtcagggtcaacctcgtcggcaccgtcgatggcgaggtcgatgagcgggttgtcgtcgagcgtggagagcgggatgccgagcgactgcgcctgctcgaaggtgcgcttggatgtgggcacgccgacgatcttctcgagcttgcccgcggccaggagcgcgccgatctcggcgacggcgaaggcggccgtggagcccgtcccgagcccgagcaccatcccgctcttcacctgctcgacggcgcgcaccgccgccagccgcttgaggtcgtcctgcgtcagcgccgccgccgccgccgccggcgcggactgcgcgcggacggccccgaggcgggcgcggcgggcggaggccacatggcgcgcggcggttgggtggaggcggactgagatcgcggtggcggccatgggagcacgtgtgggtggcgggaggggaggtgctgcagttcggagaggtgaggtcaggagtgtggggagatgagggggaggcgatgggaagttggtggtggaggctagcggcgatggtgatcgtcag

SEQ ID NO: 203 - protein, 274 aa, Zea mays
MAATAISVRLHPTAARHVASARRARLGAVRAQSAPAAAAAALTQDDLKRLAAVRAVEQVKSGMVLGLGTGSTAAFAVAEIGALLAAGKLEKIVGVPTSKRTFEQAQSLGIPLSTLDDNPLIDLAIDGADEVDPDLNLVKGRGGALLREKMVEAASDKFIVIVDETKLVDGLGGSGLAMPVEVVQFCWKYNLVRLQELFKEEGVEAKLRFEGDKPYVTDNSNYIVDLYFKTPIKDALAAGQEIAALEGVVDHGLFLNMASSVIIAGTDGVSVKTK

SEQ ID NO: 204 - protein, 185 aa, Artificial sequence
  R5PI domain
IIGIPTSTTTHEQAVSLGIPLSDLDSHPVVDLSIDGADEVDPALNLVKGRGGSLLREKMIEGASKKFVVIVDESKLVKYIGGSGLAVPVEVVPFCCDFTRGKLEELFRDSGCVAKLRMKIGSNGEEAAPAVTDNRNYVVDLYLERDIGDLEVASEAILRFPGVVEHGMFLGMATTLIVAGKFGVT

SEQ ID NO: 205 - protein, 7 aa, Artificial sequence
  motif 6
  UNSURE (2)..(2): Unknown amino acid
  UNSURE (4)..(4): Unknown amino acid
GXGXGST

SEQ ID NO: 206 - protein, 5 aa, Artificial sequence
  motif 7: active site
DGADE

SEQ ID NO: 207 - protein, 5 aa, Artificial sequence
  motif 8
  UNSURE (3)..(3): Unknown amino acid
  VARIANT (5)..(5): Xaa is Ala or Gly
KGXGX

SEQ ID NO: 208 - protein, 8 aa, Artificial sequence
  motif 9
  VARIANT (3)..(3): Xaa is Ile or Val
  VARIANT (4)..(4): Xaa is Asp or Glu
  VARIANT (7)..(7): /replace = "Leu"
GVXXHGMF

SEQ ID NO: 209 - DNA, 54 bp, Artificial sequence
  primer 5
ggggacaagtttgtacaaaaaagcaggcttaaacaatgggttctgcattcgatc

SEQ ID NO: 210 - DNA, 51 bp, Artificial sequence
  primer 6
ggggaccactttgtacaagaaagctgggtaccctaatggttttcaaatgac

SEQ ID NO: 211 - DNA, 2194 bp, Oryza sativa; identical to SEQ ID NO: 128

SEQ ID NO: 212 - DNA, 483 bp, Arabidopsis thaliana
atggctcagagaacggagaaggaagagaccgagttcaaagttctcgaaaccttgacgacaacaacaacgacgttatgtaccaataactgcggcgttacagcgaatcctgcgacgaacaacatgtgtcagaaatgtttcaacgcatctctcgtctcggcggccgcaggtgttgttgaatcaggttcgatcttgaagagatcggctagatctgtcaatcttcgttcgtcaccagctaaagtcgtgattcgtccaagagagatcgatgcggtgaagaagagagatcaacagatcgtaaaccgatgttctggttgtcggaagaaagttgggttgaccggattcaggtgccgatgcggtgagcttttctgctcagagcaccgttactccgatcgtcatgattgtagctacgactacaaaaccgctggtcgtgaggcgatcgctagagaaaatccggtggtcaaggctgcgaaaatggtcaaagtttaa

SEQ ID NO: 213 - protein, 160 aa, Arabidopsis thaliana
MAQRTEKEETEFKVLETLTTTTTTLCTNNCGVTANPATNNMCQKCFNASLVSAAAGVVESGSILKRSARSVNLRSSPAKVVIRPREIDAVKKRDQQIVNRCSGCRKKVGLTGFRCRCGELFCSEHRYSDRHDCSYDYKTAGREAIARENPVVKAAKMVKV

SEQ ID NO: 214 - DNA, 492 bp, Medicago truncatula
atggctcaaagaacagaaaatgaagaaaccgaatttaaggtggtttcagaaacccttcaacaaacaacaacaataataaatctttgtatcaaaaactgcggtgttgtcggaaacccttcaacaaacaacatgtgtcaaaattgtttcacagcatcaacgacaatcttaccaccttcatcttctagatctgttcggtctccgaagagatctcgtcaagaatcatcatcatcatcagaagaagaagggtcaacggatcatgatttggttgatgaaaaaacggtttctgaggtgaagagggttgttagtagatgctccggttgtcggagaaaggttgggttggctggatttcgatgtagatgtggggagttgttttgtgcagatcatcgatactctgatcgacatgattgtgggtatgattataagaaggttggtagagaagagattgcaagggagaatcctgttatcagagctgcgaaaattgtgaaggtgtga

SEQ ID NO: 215 - protein, 163 aa, Medicago truncatula
MAQRTENEETEFKVVSETLQQTTTIINLCIKNCGVVGNPSTNNMCQNCFTASTTILPPSSSRSVRSPKRSRQESSSSSEEEGSTDHDLVDEKTVSEVKRVVSRCSGCRRKVGLAGFRCRCGELFCADHRYSDRHDCGYDYKKVGREEIARENPVIRAAKIVKV

SEQ ID NO: 216 - DNA, 507 bp, Arabidopsis thaliana
atgggttctgagcaaaacgacagcacaagcttctctccttcagagccaaagctctgcgtcaaaggatgtggcttcttcggatctccatcgaacatgaacctctgctctaaatgctacagagacatccgagccacggaggaacaaaccgcttccgctaaagccgccgtcgagaaatctctaaaccctaataaacccaaaactcaaccacaacagagccaagaaatcactcaaggcgtcctcggatctggatcgtcttcctcatcaacgagagggggtgattcggctgctgctccgttggatccaccgaaatcgacggctacgagatgcttgagctgtaacaagaaagttggcgtgacgggtttcaagtgtaggtgtggaagcactttctgtggaactcatagatatccagagagtcacgagtgccaattcgatttcaaaggagttgcgagagaagctattgctaaagctaatcctgtggtgaaggctgataaggttgataggatatga

SEQ ID NO: 217 - protein, 168 aa, Arabidopsis thaliana
MGSEQNDSTSFSPSEPKLCVKGCGFFGSPSNMNLCSKCYRDIRATEEQTASAKAAVEKSLNPNKPKTQPQQSQEITQGVLGSGSSSSSTRGGDSAAAPLDPPKSTATRCLSCNKKVGVTGFKCRCGSTFCGTHRYPESHECQFDFKGVAREAIAKANPVVKADKVDRI

SEQ ID NO: 218 - DNA, 522 bp, Arabidopsis thaliana
atggaccacgacaagacaggatgccaaagcccacctgaaggtcccaagctatgtactaacaactgcggtttctttggaagcgctgccacaatgaacatgtgttctaagtgtcacaaggatatgttgttccaacaggagcagggcgctaagtttgcatctgcagtgtctggaacatcgtcatccagcaacatcataaaggaaacctttaccgctgcgttggtcgatattgaaaccaaatccgttgagccgatgactgtttctgtacagccatcctctgtccaagtcgttgcagaggtagtagcaccagaagaagctgcgaaaccaaagggaccaagccgatgtactacttgcaataagcgggttggcctgactggattcaaatgtcgctgtgggagcctcttctgcggaacacaccgctatgcagacgtacatgactgctccttcaattaccatgctgctgcgcaagaggcgatagctaaggcaaacccggttgtgaaagcagagaagcttgacaaaatctga

SEQ ID NO: 219 - protein, 173 aa, Arabidopsis thaliana
MDHDKTGCQSPPEGPKLCTNNCGFFGSAATMNMCSKCHKDMLFQQEQGAKFASAVSGTSSSSNIIKETFTAALVDIETKSVEPMTVSVQPSSVQVVAEVVAPEEAAKPKGPSRCTTCNKRVGLTGFKCRCGSLFCGTHRYADVHDCSFNYHAAAQEAIAKANPVVKAEKLDKI

SEQ ID NO: 220 - DNA, 492 bp, Arabidopsis thaliana
atggcggaagaacacagacttcaagaaccacgattatgtgctaacaattgtggcttcttcggaagcacagctacacaaaatctctgttccaaatgttttcgagatcttcaacatcaagaacaaaactcttccaccgccaaacatgctcttacccaatccttagccgccgttggcgctgctgcgtcttcctccgtgtcgccaccgcctccgcctccagctgattcgaaagaaatcgttgaagcgaaatcagagaaacgagcggcggctgaaccggaggaggcggatggtccgccgcaagatccgaagcggtgtttgacttgtcggcggcgcgtgggaatcacggggtttcggtgtaggtgtggtttcgttttctgcgggacgcataggtacgcggagcaacatgaatgttcgtttgatttcaagcggatggggaaggataagatcgctaaagcgaatccgattgtgaaagctgataagcttgagaagatttga

SEQ ID NO: 221 - protein, 163 aa, Arabidopsis thaliana
MAEEHRLQEPRLCANNCGFFGSTATQNLCSKCFRDLQHQEQNSSTAKHALTQSLAAVGAAASSSVSPPPPPPADSKEIVEAKSEKRAAAEPEEADGPPQDPKRCLTCRRRVGITGFRCRCGFVFCGTHRYAEQHECSFDFKRMGKDKIAKANPIVKADKLEKI

SEQ ID NO: 222 - DNA, 486 bp, Arabidopsis thaliana
atggcggaagaacatcgatgcgagacgcctgaaggtcaccgtctctgcgttaacaactgcggtttcttcggaagctcagcgacaatgaatctatgttcaaactgttacggcgatctctgtctcaaacaacaacaacaagcttccatgaaatcaaccgtcgaatcatctctctctccggtgatcgcacctgttctcgaaaactacgcggcggagttagagatcccgacgacgaagaagacagaggagaaaaaaccgattcaaattccgacggagcaaccgtctccgccgcaacggccgaatcgatgcaccgtatgtaggaaacgggtcgggttaaccgggtttatgtgtcggtgtgggacgactttttgtgggagtcataggtatccggaggttcatggttgtacgtttgatttcaaatcggcgggacgtgaagagatcgcgaaagctaatccgttggttattgcggcgaagcttcagaaaatatga

SEQ ID NO: 223 - protein, 161 aa, Arabidopsis thaliana
MAEEHRCETPEGHRLCVNNCGFFGSSATMNLCSNCYGDLCLKQQQQASMKSTVESSLSPVIAPVLENYAAELEIPTTKKTEEKKPIQIPTEQPSPPQRPNRCTVCRKRVGLTGFMCRCGTTFCGSHRYPEVHGCTFDFKSAGREEIAKANPLVIAAKLQKI

SEQ ID NO: 224 - DNA, 513 bp, Arabidopsis thaliana
atggcggaagagcatcgatgtcagacaccagaaagcaaccgtctctgtgttaacaactgtggcttcctcggcagctccgccaccatgaatctctgttctaattgttacggcgatctttgtctcaaacaacaacaacaatcctcctccatcaaatccaccgttgaatcttccctctctgtatctcctccgtcgtcatcatcatcggagatctcttctccgatcatccctcctctccttaaaaatccatcagtcaagctagaggtaccggagaaaaaggcggtgatttcgctgccgacgacggagcagaatcagcaacagaggccgaatcggtgcacgacgtgtaggaaacgggtcgggttaaccggattcaagtgccggtgcggtacgatgttttgcggggttcataggtacccggagatccatggatgcagctacgatttcaaatcggccggacgtgaagagatcgcgaaagcgaatccgttggtgaaagcagcgaagcttcagaagatatga

SEQ ID NO: 225 - protein, 170 aa, Arabidopsis thaliana
MAEEHRCQTPESNRLCVNNCGFLGSSATMNLCSNCYGDLCLKQQQQSSSIKSTVESSLSVSPPSSSSSEISSPIIPPLLKNPSVKLEVPEKKAVISLPTTEQNQQQRPNRCTTCRKRVGLTGFKCRCGTMFCGVHRYPEIHGCSYDFKSAGREEIAKANPLVKAAKLQKI

SEQ ID NO: 226 - DNA, 528 bp, Arabidopsis thaliana
atgggctcagaggaaaacaacagcacaagctttccaccaacagagccaaagctctgtgataacggatgtggattcttcgggtcaccatccaacatgaatctctgctcgaaatgttacagaagcttaagagccgaggaagatcaaaccgcggtagcgaaagctgcggtgaagaactctttaaagcttccatcttgcagtatcattgcacctggacaaaaacatcctctggaaattaaaccagctcatttggaaaccgttgttgtaaccgctgagccgtcttctgtacctgtagccgcggaacaggacgaggctgagccgtcgagacctgttagaccgaacaacaggtgtttcagctgtaacaagaaggttggtgtaatggggtttaagtgcaaatgcggtagcacgttttgcgggagtcataggtacccggagaagcatgagtgtagcttcgatttcaaagaagttggacgtgatgcaattgcaaaggctaatcctttggttaaggcggataaagttcagaggatttga

SEQ ID NO: 227 - protein, 175 aa, Arabidopsis thaliana
MGSEENNSTSFPPTEPKLCDNGCGFFGSPSNMNLCSKCYRSLRAEEDQTAVAKAAVKNSLKLPSCSIIAPGQKHPLEIKPAHLETVVVTAEPSSVPVAAEQDEAEPSRPVRPNNRCFSCNKKVGVMGFKCKCGSTFCGSHRYPEKHECSFDFKEVGRDAIAKANPLVKADKVQRI

SEQ ID NO: 228 - DNA, 378 bp, Arabidopsis thaliana
atgacgggagaaccttctttatgcattagggggtgtggcttcttcagcacgtcacagacgaagaacctctgttctaagtgctacaacgatttcttaaaggacgagtctgccagatacttggccactttcaacgtcaacacgaaagccgctgaagaggtcacggcgcaagaggcgacggtactcggtagtaaaggcggttgtgcgtgcaagaagaaggtggggttgctagggtttcactgtagatgtggccacttattcttcgcgtctcaccgttacccggaagagcattcatgtccatcggattataaatctgccgccattgacgtcttagcaaaacaaaaccctgtcgtcaagggtgataagctcttcagactttag

SEQ ID NO: 229 - protein, 125 aa, Arabidopsis thaliana
MTGEPSLCIRGCGFFSTSQTKNLCSKCYNDFLKDESARYLATFNVNTKAAEEVTAQEATVLGSKGGCACKKKVGLLGFHCRCGHLFFASHRYPEEHSCPSDYKSAAIDVLAKQNPVVKGDKLFRL

SEQ ID NO: 230 - DNA, 531 bp, Arabidopsis thaliana
atgggatcggaacaaaacgatagcacaagcttcacgcaatcgcaagcttcagagccaaagctatgtgttaaaggatgtggtttctttggatcaccatcaaacatggatctctgttctaaatgttacagaggcatttgtgctgaggaagctcaaacagcagttgctaaagctgctgttgaaaaatctttcaagccttctcctcctcgtagtctcttcatagcagaacctcctgctgttgttgtggaacccaaacccgaaaaggcggcagttgttgttgtctcggccgagccatcttcctcggcggttcctgaggcgaacgagccatcgagacctgcacgaaccaaccggtgtttgtgttgtaacaagaaggttgggatcatggggtttaagtgcaaatgcgggagcactttctgcggcgaacatcggtacccggagactcatgattgcagctttgatttcaaagaagttggacgtggagagattgccaaagctaatcctgtggttaaggctgataaaattcaaaggttctga

SEQ ID NO: 231 - protein, 176 aa, Arabidopsis thaliana
MGSEQNDSTSFTQSQASEPKLCVKGCGFFGSPSNMDLCSKCYRGICAEEAQTAVAKAAVEKSFKPSPPRSLFIAEPPAVVVEPKPEKAAVVVVSAEPSSSAVPEANEPSRPARTNRCLCCNKKVGIMGFKCKCGSTFCGEHRYPETHDCSFDFKEVGRGEIAKANPVVKADKIQRF

SEQ ID NO: 232 - DNA, 393 bp, Arabidopsis thaliana
atggtgaacgaaacagaagcattaccatgcgagggaggctgtggactctacggcacccgagtgaacaacaatctatgctctctctgctacaaaaagagtgttcttcaacactcgcccgctttaagattcgaacccgagaccgagcaatcacagtgttgccctcctacgaatagtcccgccgttgaagaagaaccggtcaaaaaaaggagatgtgggatatgtaagaggaaggtaggaatgttgggattcaagtgtagatgtggacacatgttttgcgggtcacatcgttatccggaggagcattcttgtccctttgattacaaacaatctggacggctcgccttggccacacagttgcctttgatcagagctgacaagttgcagaggttttag

SEQ ID NO: 233 - protein, 130 aa, Arabidopsis thaliana
MVNETEALPCEGGCGLYGTRVNNNLCSLCYKKSVLQHSPALRFEPETEQSQCCPPTNSPAVEEEPVKKRRCGICKRKVGMLGFKCRCGHMFCGSHRYPEEHSCPFDYKQSGRLALATQLPLIRADKLQRF

SEQ ID NO: 234 - DNA, 567 bp, Lycopersicon esculentum
atggctcagagaacggagaaagaagagacggagttcaaggccgtacctgaaacgataacgctttgcatcaacaattgtggagttacaggaaatccagccacaaacaatatgtgtcaaaagtgcttcaacgccaccaccgcggctacctcaacttcatccagctcgccgacggggacgtcggtgacgattcctcacaatttcgctgaaaaattggtcagatctgaaaaatcggcgagattcagctcgttgaggtcgtcgccggacaggaagtctgatctggacaggatgagtcaagatctgaagaaagttggagatacgatgatggtaaaggaggaggatcaactgaaggcaagcttaccgccggctaagagagaggtgaatcgttgctccggttgtcgaaggaaggtaggattgaccggattccgatgccggtgcggcgagttgttttgcggtgaacatcgatactccgatcgtcatgattgtagctacgactacaaaaccgccggccgagaagcgatcgcgagggagaatccagtcgtgaaagcagcaaaaatcattaaagtttga

SEQ ID NO: 235 - protein, 188 aa, Lycopersicon esculentum
MAQRTEKEETEFKAVPETITLCINNCGVTGNPATNNMCQKCFNATTAATSTSSSSPTGTSVTIPHNFAEKLVRSEKSARFSSLRSSPDRKSDLDRMSQDLKKVGDTMMVKEEDQLKASLPPAKREVNRCSGCRRKVGLTGFRCRCGELFCGEHRYSDRHDCSYDYKTAGREAIARENPVVKAAKIIKV

SEQ ID NO: 236 - DNA, 504 bp, Lycopersicon esculentum
atggaacaaaatgatacaggctgccaagctcctcaagctcctgtcctttgtgttaacaattgtgggttttttggtactgcagcaacaatgaacatgtgctcaaagtgctacaaggatatgatattcaagcaagaacaagcaaactttgctgcttcatctattgaaagctttgtaaatggaagttcaaatgctagtgtgaaagctgttgatgttgctgtcaccgtgcaggaaggtcctgcagagtccctggttatacccacacaagtcgcggtaccagtagagagtgaacaagttgagaaggctaaggaggggccaaacaggtgcagcacctgtaggagacgagttggtttgaccggcttcaactgccgatgtgggaatcttttctgctcagctcatcgctactcagacaaacatgagtgtccatatgattatcgcaaggctggtcaagatgctattgcgaaagccaacccagttgttaaggctgaaaagcttgacaaaatatga

SEQ ID NO: 237 - protein, 167 aa, Lycopersicon esculentum
MEQNDTGCQAPQAPVLCVNNCGFFGTAATMNMCSKCYKDMIFKQEQANFAASSIESFVNGSSNASVKAVDVAVTVQEGPAESLVIPTQVAVPVESEQVEKAKEGPNRCSTCRRRVGLTGFNCRCGNLFCSAHRYSDKHECPYDYRKAGQDAIAKANPVVKAEKLDKI

SEQ ID NO: 238 - DNA, 447 bp, Oryza sativa
atggagcagggaagcgagaggcaggacgagcggccgccgctcccgtgcgcgaacggctgcggcttcttcggctctgccgacacccgtggcctctgctccaagtgctaccgccagaccgtgatgtcccaggcctccgcgccgtcggccgcagcacagtccgcggagcacgaccaggtggtgttgccggcgccggagggcgtacccgtggacgagggggcgatgccgccgccgccgccgcggcacggggcgaagacgaagagcaggtgcgctgcgtgcgggaggagcgtggggctgatggggttcgagtgccgctgcggtgccgtgttctgcggcgcgcatcgctactcggacaggcacgactgcggctacgattacaggggcgccgggcgcgacgccatcgcccgcgccaaccccgtcgtgagacccgacaaggtggagaagctctga

SEQ ID NO: 239 - protein, 148 aa, Oryza sativa
MEQGSERQDERPPLPCANGCGFFGSADTRGLCSKCYRQTVMSQASAPSAAAQSAEHDQVVLPAPEGVPVDEGAMPPPPPRHGAKTKSRCAACGRSVGLMGFECRCGAVFCGAHRYSDRHDCGYDYRGAGRDAIARANPVVRPDKVEKL

SEQ ID NO: 240 - DNA, 498 bp, Oryza sativa
atgtcgtcggagcagcaggcgagcgccggccaaccggtcctctgtgccagtggctgcggcttctacgggaaccccgccaccctcgacatgtgctccgtctgctaccgccagcactgcctcctcaacggcgccacgatggcgacggggccctcctcttccgtggccgccgcgagcgccgctaccgtcgcgaccggcgcagttacgtctgattcctgctccgtgccttccgctgaggttaatggcgccgcattctcctccaagaacaaccctgagccggcgacggtagtagagaagaaggcgccggcgaaccggtgcgcgtcgtgcaagaagaaggtgggactgttggggttcgcatgccgatgcggggctacctactgcgggacgcaccgatacccggagaagcacgcctgcggcttcgacttcaagggcgccagccgcgacgccatagcccgcgccaacccgctcatcaagggcgagaagctgaccaacaagatctga

SEQ ID NO: 241 - protein, 165 aa, Oryza sativa
MSSEQQASAGQPVLCASGCGFYGNPATLDMCSVCYRQHCLLNGATMATGPSSSVAAASAATVATGAVTSDSCSVPSAEVNGAAFSSKNNPEPATVVEKKAPANRCASCKKKVGLLGFACRCGATYCGTHRYPEKHACGFDFKGASRDAIARANPLIKGEKLTNKI

SEQ ID NO: 242 - DNA, 522 bp, Oryza sativa
atggaacacaaggaggctggctgccagcagcccgagggcccaatcctttgcatcaataactgcggcttctttggcagcgcggcgaccatgaacatgtgctccaagtgccacaaggagatgatcatgaaggaggagcaggccaagcttgctgcctcctccatcgatagcattgtcaatggttgtgacggtgggaaggagcatattgttgctgccagtggtagcacggcggtggcggtggctcaggtcgaggcgaagacgctcgttgtgcagcctaccgatgtcgcgggcaccagcgaggaggttgctgtagtccccaaggtcaaggaagggccgaaccggtgcgctacctgtaggaagagggttgggctgacgggattcaactgccggtgcggtaacatgtactgtgcgttgcaccgctactccgacaagcatgaatgccagttcgactaccggactgcggctagggatgccatcgccaaggccaacccagtggtgaaggctgagaagctcgacaagatctaa

SEQ ID NO: 243 - protein, 173 aa, Oryza sativa
MEHKEAGCQQPEGPILCINNCGFFGSAATMNMCSKCHKEMIMKEEQAKLAASSIDSIVNGCDGGKEHIVAASGSTAVAVAQVEAKTLVVQPTDVAGTSEEVAVVPKVKEGPNRCATCRKRVGLTGFNCRCGNMYCALHRYSDKHECQFDYRTAARDAIAKANPVVKAEKLDKI

SEQ ID NO: 244 - DNA, 465 bp, Oryza sativa
atggctgaggagcagaggtggcaggagggctgccaccgcctgtgcgccaacaactgcggcttcttcggtagccccgccacgctcgacctctgctccaagtgctaccgcgaccgccaaggccgggagagtactgcacccgtcgtcgtcgccgccgcagcctcggcctgcccggctactcatccttcctcgccatcctcgtcgtcttgtccggcgttcttgccttcctccactgccgccgaggctggcgtcgtcgtcgcggcggtggcgaaggcgagcaggtgcgcgagctgtaggaagcgggtggggcttacggggttcgcgtgccggtgcggcggcacgttctgcggcgcacaccggtacccggagcggcacgcgtgcggcttcgacttcaaggccgccggccgcgacgccatcgcgcgcgccaacccgctcatcaagggcgacaagctcaaggacaagatctga

SEQ ID NO: 245 - protein, 154 aa, Oryza sativa
MAEEQRWQEGCHRLCANNCGFFGSPATLDLCSKCYRDRQGRESTAPVVVAAAASACPATHPSSPSSSSCPAFLPSSTAAEAGVVVAAVAKASRCASCRKRVGLTGFACRCGGTFCGAHRYPERHACGFDFKAAGRDAIARANPLIKGDKLKDKI

SEQ ID NO: 246 - DNA, 483 bp, Oryza sativa
atggcacaagagagctggaaaaaggaggcagaggagactggagtccacacacctgaggcccctatattgtgcgttaacaactgtggcttctttggcagccggatgacagaaaacatgtgctcaaagtgttatagggacaccgttaaggccaagacagtggccactgttgtggagaagaaacctcttgcttcattgtcttccacacctttggtgacagaagtcacagatggagggtctggttcagttgcagatgggaaacaagtaatggaggaggatacaccaaagccacccagtaaccgttgcttatcatgccggaagaaggttgggttgacaggattcaagtgccgctgcggaggcaccttctgttcaatgcaccgctatgccgattcacacaaatgcacatttgattacaagcaggtcgggagggagcagattgccaaacagaatcctcttgtgaaagctgacaagatcaccaaaatctga

SEQ ID NO: 247 - protein, 160 aa, Oryza sativa
MAQESWKKEAEETGVHTPEAPILCVNNCGFFGSRMTENMCSKCYRDTVKAKTVATVVEKKPLASLSSTPLVTEVTDGGSGSVADGKQVMEEDTPKPPSNRCLSCRKKVGLTGFKCRCGGTFCSMHRYADSHKCTFDYKQVGREQIAKQNPLVKADKITKI

SEQ ID NO: 248 - DNA, 510 bp, Oryza sativa
atggcgtcgatgaagcggaagtgccccgatgacgagacggcctgcggctccggcgccggcgccgccatgtgcgtcaccggctgcggattcttcggctccgaggccaccaacaacatgtgctcccggtgctaccgcgagcactccgcggacaacgacgccgtggaggaggcggcggcagccaacagcgacctcgagctggttggcgtggcggagacgacgacgaagaaggccaggatgagcgccgtcgtccccgtcgccgtcgcgtcatcttcatcggcggcggcagagcagccggcggcgaaggctgctacggcgccgaaccggtgcgcggcgtgccggaagaaggtggggctgacggggttcaagtgccggtgcggcggcaacttctgtggcggccaccgccacgccgacgcccacggctgcggcttcgactacaagagcgccgggaaggagcagatcgccaagcagaacccgctcgtcgtcgccgacaagctggccacccggatttga

SEQ ID NO: 249 - protein, 169 aa, Oryza sativa
MASMKRKCPDDETACGSGAGAAMCVTGCGFFGSEATNNMCSRCYREHSADNDAVEEAAAANSDLELVGVAETTTKKARMSAVVPVAVASSSSAAAEQPAAKAATAPNRCAACRKKVGLTGFKCRCGGNFCGGHRHADAHGCGFDYKSAGKEQIAKQNPLVVADKLATRI

SEQ ID NO: 250 - DNA, 516 bp, Oryza sativa
atggagcacaaggagactggatgccagcagccagaaggcccgatcctttgcatcaataactgcggcttctttggcagtgcggctaccatgaacatgtgctcaaagtgccacaaggagatgataatgaagcaggagcaggccaagctggcagcctcctctatcgacagcattgtcaatggtggtgattccgggaaggaaccaattattgctggtcacgctgaagtagctgttgctcaagtcgaggtgaagacgcttgttgcgcagcctgctgagattgctggtcctagtgagggggtcacggtgaaccccaaggggagggaaggaccaaatcggtgctccacttgtcggaagagggttggtcttaccggattcaactgccgatgtggcaacttgtactgcgcaatgcaccgctattccgataagcatgactgccagtttgactatcggaccgctgctagggatgctattgccaaggctaatccggtggtgaaggcggagaaacttgacaaaatttag

SEQ ID NO: 251 - protein, 171 aa, Oryza sativa
MEHKETGCQQPEGPILCINNCGFFGSAATMNMCSKCHKEMIMKQEQAKLAASSIDSIVNGGDSGKEPIIAGHAEVAVAQVEVKTLVAQPAEIAGPSEGVTVNPKGREGPNRCSTCRKRVGLTGFNCRCGNLYCAMHRYSDKHDCQFDYRTAARDAIAKANPVVKAEKLDKI

SEQ ID NO: 252 - DNA, 486 bp, Oryza sativa
atggcacaagaaagctggaaaaatgagtctgaggagactgtccacacaccggaggccccaatattgtgtgtaaacaactgtggcttcttcggcagtagcatgacgaacaatatgtgttcgaagtgctacagggactttgtgaaggtcacgacaatggctgccccagtagtggagaagaaggcatttacgccagcatcgtcttcgaagacaccattggagccagcaaagccagatgaagttcctgccgcagctgtagaggataagcaagcggcacaggagcctccaaagccacccagcaaccgatgcctgtcatgccgtaagaaggttggtctgactggcttccagtgccgatgcggaggtaccttctgctcaacacaccgttataccgaagctcacgactgcaccttcgactacaagaaggccggccgggatcagattgccaagcagaatcctgttgtgatagccgagaagatcaacaagatctga

SEQ ID NO: 253 - protein, 161 aa, Oryza sativa
MAQESWKNESEETVHTPEAPILCVNNCGFFGSSMTNNMCSKCYRDFVKVTTMAAPVVEKKAFTPASSSKTPLEPAKPDEVPAAAVEDKQAAQEPPKPPSNRCLSCRKKVGLTGFQCRCGGTFCSTHRYTEAHDCTFDYKKAGRDQIAKQNPVVIAEKINKI

SEQ ID NO: 254 - DNA, 675 bp, Oryza sativa
atggaggagcagcaggcggcggctgcgggcggcggaggcggcggcggcggcgcgtcgatgtgcgcgaacgggtgcggcttcttcggcagcgaggcgaccaagaagctctgctccaagtgctaccgcgaccagctcaaggcggcgccgtcgtcgccgccggcggcgcctgacctcgtcgcgaacgaggaggaggaggcgagcacggccgccgccgccgccgccgacgagcagctggcgctgtgctcgagcggctgcgggttcttcggcagcaaggagaccaacaacatgtgctccaagtgctaccgcgaccacctcaaggcgacgtcgccgttgttctcgtcgtcgtcgtcgccggccaccgcatccactaccgacatcaccgtccccattgctccggccaccacggcgccgacgccgtcgctcaaggggaaggaggaggaggcgaccgccgccgcgtcatcgtcggcggcggcggcggcgaagcctaacaggtgcgtggcgtgccggaagaaggtggggctgctgggcttcgagtgccgatgcggcggcacgttctgctcgacgcaccgccacgccgacaagcacgcctgcaccttcgacttcaagaagagcgaccgggagaagatcgccaaggagaacccgctgatcgtagcgcccaagatcaccaagttctga

SEQ ID NO: 255 - protein, 224 aa, Oryza sativa
MEEQQAAAAGGGGGGGGASMCANGCGFFGSEATKKLCSKCYRDQLKAAPSSPPAAPDLVANEEEEASTAAAAAADEQLALCSSGCGFFGSKETNNMCSKCYRDHLKATSPLFSSSSSPATASTTDITVPIAPATTAPTPSLKGKEEEATAAASSSAAAAAKPNRCVACRKKVGLLGFECRCGGTFCSTHRHADKHACTFDFKKSDREKIAKENPLIVAPKITKF

SEQ ID NO: 256 - DNA, 513 bp, Oryza sativa
atggcgcagagggagaagaaggtggaggagccgacggagctgagggcgccggagatgacgctctgcgccaacagctgcgggttcccgggcaacccggcgaccaacaacctctgccagaactgcttcttggctgcctcggcgtcttcttcttcttcttccgccgctgcctcgccgtcgacgacgtcgttgccggtgtttccggtggtggagaagccgaggcaggccgtacagtcgtcggcggcggcggcggtggcgctggtggttgagcggccgacggcggggccggtggagtcgtcgtcgaaggcgtcgaggtcgtcgtcggtcaaccgatgccacagctgccggaggcgggtgggcctgaccgggttccggtgccgctgcggcgagctctactgcggcgcgcaccggtactccgaccgccacgactgcagcttcgactacaagtcggcggcgagggacgccatcgccagggagaaccccgtcgtccgcgccgccaagatcgttaggttctaa

SEQ ID NO: 257 - protein, 170 aa, Oryza sativa
MAQREKKVEEPTELRAPEMTLCANSCGFPGNPATNNLCQNCFLAASASSSSSSAAASPSTTSLPVFPVVEKPRQAVQSSAAAAVALVVERPTAGPVESSSKASRSSSVNRCHSCRRRVGLTGFRCRCGELYCGAHRYSDRHDCSFDYKSAARDAIARENPVVRAAKIVRF

SEQ ID NO: 258 - DNA, 495 bp, Oryza sativa
atggcgcagcgcgacaagaaggatcaggagccgacggagctcagggcgccggagatcacgctgtgcgccaacagctgcggattcccgggcaacccggccacgcagaacctctgccagaactgcttcttggcggccacggcgtccacctcgtcgccgtcttctttgtcgtcaccggtgctcgacaagcagccgccgaggccggcggcgccgctggttgagcctcaggctcctctcccaccgcctgtggaggagatggcctccgcgctcgcgacggcgccggcgccggtcgccaagacgtcggcggtgaaccggtgctccaggtgccggaagcgtgtcggcctcaccgggttccggtgccggtgcggccacctgttctgcggcgagcaccggtactccgaccgccacggctgcagctacgactacaagtcggcggcgagggacgccatcgccagggacaacccggtggtgcgcgcggccaagatcgttaggttctga

SEQ ID NO: 259 - protein, 164 aa, Oryza sativa
MAQRDKKDQEPTELRAPEITLCANSCGFPGNPATQNLCQNCFLAATASTSSPSSLSSPVLDKQPPRPAAPLVEPQAPLPPPVEEMASALATAPAPVAKTSAVNRCSRCRKRVGLTGFRCRCGHLFCGEHRYSDRHGCSYDYKSAARDAIARDNPVVRAAKIVRF

SEQ ID NO: 260 - DNA, 546 bp, Populus tremuloides
atggctcaaagaacagagaaagaagagaccgagtgcaaggtaccagaaaacttgactttatgtatcaataattgtggagttacaggtaatccagcaacaaacaacatgtgtcagaaatgtttcaacgctagcaccagcacatctaatccctcctcctccaccaccaccaccaccaccaccataacatttgcagcaacaaccaacggtgtgtctaccaacgagatcttaaaattcaccagcgagaaatcgttgagatccagcatatctcgctcgccggcgaaggatcatcaaaggcaaccaaaaactgcgtcggataaagaaagatctgacagttcttccgtggcgaagaaagaggtgaacaggtgctcagggtgccgacgaagggtagggttgaccggattccgatgtcgttgcggggagcttttttgctgggagcaccggtactcagatcgacatgattgtagttacgattacaaaactgtaggtcgcgaagctatcgcgagagagaatcctgttgtgaaagctgcaaagattgttagagtttga

SEQ ID NO: 261 - protein, 181 aa, Populus tremuloides
MAQRTEKEETECKVPENLTLCINNCGVTGNPATNNMCQKCFNASTSTSNPSSSTTTTTTTITFAATTNGVSTNEILKFTSEKSLRSSISRSPAKDHQRQPKTASDKERSDSSSVAKKEVNRCSGCRRRVGLTGFRCRCGELFCWEHRYSDRHDCSYDYKTVGREAIARENPVVKAAKIVRV

SEQ ID NO: 262 - DNA, 540 bp, Populus tremuloides
atggctcaaagagcagagaaagaagagaccgagttcaaggtaccagaaaccttgacttcatgtatcaataattgtggagttacgggtaatcctgcaactaacaacatgtgtcagaaatgtttcaacgctagcaccagcacgtctaattcttcttcctcttccaccgccactagcatgacgtttgcagcaacagccaccagcgtatctaacaacgagatcttaaaattcaccggcgagaagtcggcgagatccagcatatctcgttcgctggtgaaagatccacaaaagtcgcctgaaacagcatcggataaagaaagatcctgtgcctatcatgtggcgaagaaagaggtgaacaggtgctcagggtgccgaagaagagtgggattgactggattccggtgtcggtgtggggagctgttttgctgggagcatcggtactcagatcgacatgattgtagctacgattacaaaactgcaggtcgcgaagctatcgcgagagagaatcctgttgttaaagctgccaagattgttagagtctga

SEQ ID NO: 263 - protein, 179 aa, Populus tremuloides
MAQRAEKEETEFKVPETLTSCINNCGVTGNPATNNMCQKCFNASTSTSNSSSSSTATSMTFAATATSVSNNEILKFTGEKSARSSISRSLVKDPQKSPETASDKERSCAYHVAKKEVNRCSGCRRRVGLTGFRCRCGELFCWEHRYSDRHDCSYDYKTAGREAIARENPVVKAAKIVRV

SEQ ID NO: 264 - DNA, 519 bp, Populus tremuloides
atggaccatgacgagacaggatgccaagctcctccagaaggtcctattttgtgtactaacaattgtggcttctttggaagtgcagctactatgaacatgtgttcaaagtgccacaagggtatgctgttaaaacaggagcaggctaatcttgctgcgtcatctattggaagtattgtgaatggatcatcaagcagcaatgtttttgaacctgttattgctgacatcattgatgtccaaaacaatgcagtggagcctaagaccatcactgtgcagccatcctgtgcttcaggctcaggggagagggttgaggcaaagccgaaggagggtccaaaccggtgcacctcttgcaagaaaagagtaggtttaacagggttcaagtgtcgatgtggtagcctcttttgtgcatctcatcgctactcagataaacatgactgcccatttgattatcgttctgctgcccgtgaagcaatagcaaaagccaaccctgttgtcaaggcagagaagcttgataaaatctaa

SEQ ID NO: 265 - protein, 172 aa, Populus tremuloides
MDHDETGCQAPPEGPILCTNNCGFFGSAATMNMCSKCHKGMLLKQEQANLAASSIGSIVNGSSSSNVFEPVIADIIDVQNNAVEPKTITVQPSCASGSGERVEAKPKEGPNRCTSCKKRVGLTGFKCRCGSLFCASHRYSDKHDCPFDYRSAAREAIAKANPVVKAEKLDKI

SEQ ID NO: 266 - DNA, 519 bp, Populus tremuloides
atggaccgtgacgagacaggatgccaagctcctccagaacgtcctattttgtgcattaacaattgtggcttctttggaagtgcagctactatgaacatgtgttcaaagtgccacaaggatatgctgttaaaacaggagcagactaagcttgctgcatcatcaattggaagtattgtgaatggatcggcaagcagcaatgtgaatgaacctgttattgctgacaccattaatgtccaaatcaatgcagtggagcctaagaccatcactgtgcagccatcctgtgcttcagtttcaggggagagagttgaggcaaagccgaaggaggggccaagccggtgcacctcttgcaagaaaagagttggtttaacagggtttaagtgtcgatgtggtgacctcttttgtgcatctcatcgctactcagacaaacatgactgcccatttgattaccgtactgctgcccgtgaagcaatagcaaaagccaatcctgttgtcaaggcagagaagcttgataaaatctga

SEQ ID NO: 267 - protein, 172 aa, Populus tremuloides
MDRDETGCQAPPERPILCINNCGFFGSAATMNMCSKCHKDMLLKQEQTKLAASSIGSIVNGSASSNVNEPVIADTINVQINAVEPKTITVQPSCASVSGERVEAKPKEGPSRCTSCKKRVGLTGFKCRCGDLFCASHRYSDKHDCPFDYRTAAREAIAKANPVVKAEKLDKI

SEQ ID NO: 268 - DNA, 525 bp, Populus tremuloides
atgggttctgagcaaaacgatggcacaagcttcccaccagcagagccaaagctttgtgttaatgggtgtggattttttggtacggctgcaaacatgaacctttgctccaagtgttaccgtgaccttcgtgccgaagaagagcaagctgcctctgccaaggctgccatggaaaagacactgaatatcaatccaaaacaaaatattgattctaaggttgttgtcgatgcccctcaagttgtggtggctaattccgtgcagtcagttgtgtctgctgaagcttcttcgtcagcagaaactgttgttgctggtggtgatcaggtgccatcaaagccggcaaataggtgctttagctgcagtaagaaggttggtttgacaggattccagtgcaagtgcggtggcacttactgcgggactcataggtacgcagagaatcacgagtgcctctttgatttcaaaggtgctggccgtgatgcaatcgcgaaggcaaatcctgtgattaaggctaataaggtggagaggttctga

SEQ ID NO: 269 - protein, 174 aa, Populus tremuloides
MGSEQNDGTSFPPAEPKLCVNGCGFFGTAANMNLCSKCYRDLRAEEEQAASAKAAMEKTLNINPKQNIDSKVVVDAPQVVVANSVQSVVSAEASSSAETVVAGGDQVPSKPANRCFSCSKKVGLTGFQCKCGGTYCGTHRYAENHECLFDFKGAGRDAIAKANPVIKANKVERF

SEQ ID NO: 270 - DNA, 516 bp, Triticum aestivum
atggcgcagcgggacaagaaggtggaggagccgacggaggtgcacctgcacgccgcggagatcacgctctgcgccaacagctgcggcttcccgggcaacccggccaccaagaacctctgccagaactgcttcctggcgtcctcctcctcctcgccgtcctcctccgccgcctcaccgccgtccccttcctcctcgcccgcggccgcgttcccgctcttcgacaagccgaggccggccgccgccgcgtcgccggccgcgcccgtctacatggccgttgaccggcctgccgccgggccggcggacccgaaggcgtctaagtcgtcggtgaaccgctgccacaactgccggaagcgcgtgggcctgacggggttccgctgccggtgcggcgagatgttctgcggcgcgcaccggtactcggaccggcacgactgcagctacgactacaagtcggcggccagggacgccatcgcccgggagaaccccgtcgtgcgcgccgccaagatcgtccggttctga

SEQ ID NO: 271 - protein, 171 aa, Triticum aestivum
MAQRDKKVEEPTEVHLHAAEITLCANSCGFPGNPATKNLCQNCFLASSSSSPSSSAASPPSPSSSPAAAFPLFDKPRPAAAASPAAPVYMAVDRPAAGPADPKASKSSVNRCHNCRKRVGLTGFRCRCGEMFCGAHRYSDRHDCSYDYKSAARDAIARENPVVRAAKIVRF

SEQ ID NO: 272 - DNA, 519 bp, Vitis vinifera
atggctcagaaaacggagaaggaagagactgagttcaaagttccagaaaccctcgccctatgcgttaacaactgtggatttacaggcaatccggccacaaacaacatgtgtcagaagtgcttcagcgcctccgcttcggcggcggccgcggcagctgccggagccttgaagagtagccacaaggtgtccggcggagccgcagacgcgagatccagctccgcgaggtcccccgagcgaatggactcgctggcggagaccagcctggatcggacgaaggacgctgcctcagctgcggcggtggaggaggtcgggaaggtgaagcgggaggtgaatcggtgctctggatgcaggaggaaggtcgggctcaccggattccggtgccggtgcggggacctgttctgcgctgagcatcggtacacggatcggcacgagtgcagctacgattacaagaccgccggtcgcgaggctatcgcgcgggaaaatccggtagtgaaagctgcgaagatcgtgagagtctga

SEQ ID NO: 273 - protein, 172 aa, Vitis vinifera
MAQKTEKEETEFKVPETLALCVNNCGFTGNPATNNMCQKCFSASASAAAAAAAGALKSSHKVSGGAADARSSSARSPERMDSLAETSLDRTKDAASAAAVEEVGKVKREVNRCSGCRRKVGLTGFRCRCGDLFCAEHRYTDRHECSYDYKTAGREAIARENPVVKAAKIVRV

SEQ ID NO: 274 - DNA, 525 bp, Zea mays
atggctcagcgcgacaagaaggtggaggagccgacggagctgcgcgcgccggagctcacgctgtgcgccaacagctgcggcttcccgggtaacccggccaccaacaacctctgccaggcctgcttcctggccgccacggcttccgcctccgcctccgtctcgccgccgccgccctcctcctcctcgtctccggcggtgctccagttcgacgaccagcagcagcagcagcagcagcaaaatccgaggccgcgtgcgccggcggcgtccgggcccacggaggaaccgcccaggccggcccgtgcgccggctccggctccggcgtcgtcctcgtccgtccgccggtgccagacctgtcgcaagcgggtggggctcacgggcttccgctgccgctgcggggacctcttctgcggcgcgcaccgctactcggaccgccacgactgctgcttcgactacagggccgccggccgcgacgccatcgccagggacaaccccgtcgtgcgcgccgccaagatcgttaggttctag

SEQ ID NO: 275 - protein, 174 aa, Zea mays
MAQRDKKVEEPTELRAPELTLCANSCGFPGNPATNNLCQACFLAATASASASVSPPPPSSSSSPAVLQFDDQQQQQQQQNPRPRAPAASGPTEEPPRPARAPAPAPASSSSVRRCQTCRKRVGLTGFRCRCGDLFCGAHRYSDRHDCCFDYRAAGRDAIARDNPVVRAAKIVRF

SEQ ID NO: 276 - DNA, 525 bp, Zea mays
atggagcacaaggaggctgggtgccaggcccccgagggacccatcctctgcatcaataactgtggcttcttcggcagcgcggcgaccatgaacatgtgctctaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagtcgagttgcaaacaatgaacgtgcagcagcccgctgatgttgccggacccagcgagggggtggcggcgatctccaaaggggggaaggtagggccgaaccggtgcagcgcctgcaggaagagggttgggctcacgggattcaactgccggtgtgggaacttgtactgcgcgctccaccgctactccgacaagcacgactgcaagttcgactaccggactgctgccagggacgccattgccaaggctaatccggtggtgaaggcagacaagctcgacaagatctag

SEQ ID NO: 277 - protein, 174 aa, Zea mays
MEHKEAGCQAPEGPILCINNCGFFGSAATMNMCSKCHKEMITKQDQAKLAASSIDSIVNGSDAVMEPVVAGSNTVVAVAQVELQTMNVQQPADVAGPSEGVAAISKGGKVGPNRCSACRKRVGLTGFNCRCGNLYCALHRYSDKHDCKFDYRTAARDAIAKANPVVKADKLDKI

SEQ ID NO: 278 - DNA, 485 bp, Zea mays
atggcgcagcgcgacaagaaggaggagcccacggagctgcgggcgccggagatcgcgctctgcgccaacaactgcggcttcccgggcaacccggccacgcagaacctgtgccagagctgcttctcggcgtcgaggtcgtcgtcgtcgtcttcgcagccgtcccctacctcctctccctcagcttccgcgccggccgccgcggtgccgcagccgaggccggcgctcctggacgcggcgctgcagctggcgcctccggccgcggccgcgggccagcctgtggaggcctcggccaggacttctgccaaccggtgctccagctgccggaagcgcgtggggctgacggggttccggtgccgctgcggcgacctgttctgcggcgcgcaccggtactcggaccgccacggctgccgctacgactacaggggcgccgcccgggacgccatcgcccgggagaacccggtggtgcgcgcggccaagatcgttag

SEQ ID NO: 279 - protein, 161 aa, Zea mays
MAQRDKKEEPTELRAPEIALCANNCGFPGNPATQNLCQSCFSASRSSSSSSQPSPTSSPSASAPAAAVPQPRPALLDAALQLAPPAAAAGQPVEASARTSANRCSSCRKRVGLTGFRCRCGDLFCGAHRYSDRHGCRYDYRGAARDAIARENPVVRAAKIV

SEQ ID NO: 280 - DNA, 528 bp, Adonis aestivalis
atggcggaagaacaaagatgccaagcaccaccagaaggtcaccgtctatgcgcaaacaactgtggattctttggaagtccggcgacgttaaatctttgttccaaatgttacagagattactgccttaaagaagaacaagcttcctcagccaaaatcgccgtagaaaaatctctagccggtggatcttcttcttcctcatctaccgccacgtcttcaccaccactttctctctcctctcccgtttctctcccggagagtctctcaagcccagtcgttctaatagcgccggaaacttctccaccggattcaaatccacttccaccgtcgtcttctggaccaagccggtgctctacttgccgaagacgtgtcggattaaccgggttccgatgccggtgcgggattatgttttgtggtacgcatcggtacccggaacaacatggatgcacgtttgatttcaaggcagttggaagagaggcgattgcgaaggcgaaccccgtcgttatagccgagaagcttgacaagatatga

SEQ ID NO: 281 - protein, 175 aa, Adonis aestivalis
MAEEQRCQAPPEGHRLCANNCGFFGSPATLNLCSKCYRDYCLKEEQASSAKIAVEKSLAGGSSSSSSTATSSPPLSLSSPVSLPESLSSPVVLIAPETSPPDSNPLPPSSSGPSRCSTCRRRVGLTGFRCRCGIMFCGTHRYPEQHGCTFDFKAVGREAIAKANPVVIAEKLDKI

SEQ ID NO: 282 - DNA, 546 bp, Brassica napus
atgggttctgaacagaatgatagcacgagcttcacacaatcatcagagccgaaactttgtgcaaacggatgtggtttctttggttcgccatcaaacatggatctgtgttcgaaatgctaccgagacatatgcgcagaggaagctcaaacagctgttgcaaaagctgccgttgagaaatctttcaagccatcgccatcgcctcctcctcctaccctcttcatagcagagcctgatgtggcgaaaccagagaaagaaaaggcggttgctactgttcttgtggtggccgagccatcttctgcaacaggagaagctacagttcctgaacagaacgaaccaccatctaaacctgcacggccgaaccggtgcctttgttgcaacaagaaggttggtatacttgggtttaagtgcaaatgcgggagcactttctgcggcgaacatcggtaccctgagagacatgattgcagctttgatttcaaagaagctgggcgtggagagattgcaaaagccaatccggttattaaagctgataaacttcaaaggttctga

SEQ ID NO: 283 - protein, 181 aa, Brassica napus
MGSEQNDSTSFTQSSEPKLCANGCGFFGSPSNMDLCSKCYRDICAEEAQTAVAKAAVEKSFKPSPSPPPPTLFIAEPDVAKPEKEKAVATVLVVAEPSSATGEATVPEQNEPPSKPARPNRCLCCNKKVGILGFKCKCGSTFCGEHRYPERHDCSFDFKEAGRGEIAKANPVIKADKLQRF

SEQ ID NO: 284 - DNA, 450 bp, Brassica napus
atggcggaagaacatcgatgccaaacgccagaaggccaccgtctctgcgttaacaactgcggtttctccggcagctcagccaccatgaacctctgctccaattgctacggcgatctctgcctcaaccaacagcaagcctcctctctccccgccgcatctcctccgtcctcatcaaagatcgaatccatctcatcgtcttcaacggcggagagacaaattaagctgatcccgtcggagcagcagcagccgccgcaacggcctaaccggtgcaccgtgtgcaggaaacgggtcgggttgaccggattcatgtgccggtgcggtacgactttctgtgggacccacaggtatccggaggttcacggatgctcgtacgatttcaaatcggcggggcgcgaagagatcgcaaaggctaatcctttggtcatagccgcgaagctccagaagatatga

SEQ ID NO: 285 - protein, 149 aa, Brassica napus
MAEEHRCQTPEGHRLCVNNCGFSGSSATMNLCSNCYGDLCLNQQQASSLPAASPPSSSKIESISSSSTAERQIKLIPSEQQQPPQRPNRCTVCRKRVGLTGFMCRCGTTFCGTHRYPEVHGCSYDFKSAGREEIAKANPLVIAAKLQKI

SEQ ID NO: 286 - DNA, 492 bp, Brassica napus
atggcggaagagcatcgatgtcaaacgccggaaggccaccgtctctgtgctaataactgcggcttcctcggcaactccgcaaccatgaatctatgctccaactgctacggcgatctctgtcttaaacaacagcagcaaggctcatcctctctctccgccgtatctcctccatcgccggtgataacttccatctctactccgttgatccatcccctcgttcaaaacccatctgctgaactggagataacggcgaaggacgtgccggtgacgataacggcgacggagcagcagcagaaacggccgaaccggtgtaccacgtgtaggaaacgggtcgggttgaccgggttcaagtgccggtgcgggacgacgttttgcggggcccacaggtacccggaggtccatggatgcaccttcgatttcaaatcggccggtcgcgaagagatcgcgaaggcgaacccgttggtcaaagcggcgaagcttcagaagatttga

SEQ ID NO: 287 - protein, 163 aa, Brassica napus
MAEEHRCQTPEGHRLCANNCGFLGNSATMNLCSNCYGDLCLKQQQQGSSSLSAVSPPSPVITSISTPLIHPLVQNPSAELEITAKDVPVTITATEQQQKRPNRCTTCRKRVGLTGFKCRCGTTFCGAHRYPEVHGCTFDFKSAGREEIAKANPLVKAAKLQKI

SEQ ID NO: 288 - DNA, 501 bp, Brassica napus
atgtcggaagaacacaggcttcaggaaccacggttatgcgctaacgattgcggtttcttcggaaacaccgccacgcagaatctctgctctaaatgttttagagatctaaagcacgaacacgagaactcctccaccgccaaaaacgcccttaagcagactctcgccgcctgtgttgcctcctcctcctccgtatccccaccgcctcctcctcctcctccatcagatctgaaagaagtcaacacagagaatccggagaaacgggcagcagcgagcgagcccgaagaggaggagcagaagccgccgcaagatcctaaacgctgtttgacttgccggcggcgcgtggggatcacaggcttcaggtgcaggtgtgggttcgtgttttgtggaacccataggtacgccgagcagcacgagtgcactttcgatttcaagcgggtcgggaaggagaagatcgctaaggccaatccgattgtgaaagcggacaagctcgagaagatctga

SEQ ID NO: 289 - protein, 166 aa, Brassica napus
MSEEHRLQEPRLCANDCGFFGNTATQNLCSKCFRDLKHEHENSSTAKNALKQTLAACVASSSSVSPPPPPPPPSDLKEVNTENPEKRAAASEPEEEEQKPPQDPKRCLTCRRRVGITGFRCRCGFVFCGTHRYAEQHECTFDFKRVGKEKIAKANPIVKADKLEKI

SEQ ID NO: 290 - DNA, 534 bp, Brassica napus
atggaccacgacaaaacaggatgccaaagcccacctgaaggtcccaagctatgcatcaacaactgcggtttcttcggaagcgctgccacaatgaacatgtgttccaagtgtcacaaggctatcctgtttcaacaggaacagggggctaggtttgcatctgcagtgtctggtggtacatcatcatccagcaacatcttaaaggaaacctttgctgctaccgcgctggttgatgctgaaaccaaatccgttgagccggtggctgtctctgtacagccatcttctgtccaagttgccgcagaggtagtagctccagaagccgctgcagcaaaactaaaggaaggaccaagccgatgtgctacttgcaataaacgggttggtctgactggattcaaatgtcgctgtggtgacctcttctgcgggacgcaccgttatgcagacatacacaactgctccttcaattaccatgccgctgcgcaagaagctatagctaaagcaaacccggttgtgaaggcagagaagcttgacaaaatctga

SEQ ID NO: 291 - protein, 177 aa, Brassica napus
MDHDKTGCQSPPEGPKLCINNCGFFGSAATMNMCSKCHKAILFQQEQGARFASAVSGGTSSSSNILKETFAATALVDAETKSVEPVAVSVQPSSVQVAAEVVAPEAAAAKLKEGPSRCATCNKRVGLTGFKCRCGDLFCGTHRYADIHNCSFNYHAAAQEAIAKANPVVKAEKLDKI

SEQ ID NO: 292 - DNA, 471 bp, Brassica napus
atggcgcagggaacggagaaggaagagacggagttcaaggtcctcgaaaccttgaccaccaccactccgacgctctgctcaaacaactgcggcgttacagcgaatccagcgaccaacaacatgtgtcagaaatgtttcaacgcctccgtcgccgccgccggcgtagactcaacctcgatcttgaagagatcagccagatccgtcaacctccgatcgacgccagccagagtcgtgattcgtcccagggagatcgacccggttaagagagaccaacagacgataaagcggtgttccggctgtcggaagaaggtcggtttgaccgggttcagatgccggtgcggcgatcttttctgcgccgagcaccgttactcggatcgccccgattgcagctccgactacaaaaccgccggacgcgaggcgatcgctagagagaatccggtcgtcaaggcggcgaagatggttaaagtttaa

SEQ ID NO: 293 - protein, 156 aa, Brassica napus
MAQGTEKEETEFKVLETLTTTTPTLCSNNCGVTANPATNNMCQKCFNASVAAAGVDSTSILKRSARSVNLRSTPARVVIRPREIDPVKRDQQTIKRCSGCRKKVGLTGFRCRCGDLFCAEHRYSDRPDCSSDYKTAGREAIARENPVVKAAKMVKV

SEQ ID NO: 294 - DNA, 480 bp, Brassica napus
atggcgcagagaacggagaaggaagagacggagttcaaggtcctcgagaccttaacgacccccgccaccgccacgacgacgctctgctcaaataactgcggcgttacagcgaatccagccaccaacaacatgtgtcagaaatgtttcaacgcttccatcgccgccgccggcgtagactccggctcgacgtcgaagagagcgtcgagatccgttaatcttaggccatcaccagccaaagtcgtgatccgtcccagggagatcgatccggttaagagagatcagcagacggtaaaccggtgttccggctgtcggaagaaggtggggctgaccgggttcagatgccgatgcggtgaccttttctgctccgagcaccgttactccgatcgccatgagtgcagctacgactataaaaccgccggtcgcgaggcgatcgctagagagaacccggtggtcaaggcggcgaagatggtcaaagtttaa

SEQ ID NO: 295 - protein, 159 aa, Brassica napus
MAQRTEKEETEFKVLETLTTPATATTTLCSNNCGVTANPATNNMCQKCFNASIAAAGVDSGSTSKRASRSVNLRPSPAKVVIRPREIDPVKRDQQTVNRCSGCRKKVGLTGFRCRCGDLFCSEHRYSDRHECSYDYKTAGREAIARENPVVKAAKMVKV

SEQ ID NO: 296 - DNA, 480 bp, Brassica napus
atggcgcagaggacggagaaggaagagacggagttcaaggtcctcgaatccctgacgacccccgccaccgccacgaccacgctctgctcaaataactgcggcgttacagcgaatccagccaccaacaacatgtgtcagaaatgtttcaacgcttccatcgccgccgccggcgtagactccggttcgacgttgaagagagcgtcgagatccgtcaatcttaggcccacgccagccaaagtcgtgatccgtcccagggagatcgatccggttaagagagatcagcagacggtaaaccggtgttccggttgtcggaagaaggtcgggctgaccgggttcagatgccgatgcggtgaccttttctgctccgagcaccgttactccgatcgccatgagtgcagctacgactacaaaaccgccggtcgcgaggcgatcgctagagagaacccggtggtcaaggcggcgaagacggtcaaagtttaa

SEQ ID NO: 297 - protein, 159 aa, Brassica napus
MAQRTEKEETEFKVLESLTTPATATTTLCSNNCGVTANPATNNMCQKCFNASIAAAGVDSGSTLKRASRSVNLRPTPAKVVIRPREIDPVKRDQQTVNRCSGCRKKVGLTGFRCRCGDLFCSEHRYSDRHECSYDYKTAGREAIARENPVVKAAKTVKV

SEQ ID NO: 298 - DNA, 519 bp, Glycine max
atggagcctcatgatgagactggatgccaggctcctgaacgccccattctttgcattaataattgtggcttctttggaagagcagctaccatgaacatgtgttccaagtgttacaaggacatgctgttgaagcaggagcaggacaaatttgcagcatcatccgttgaaaacattgtgaatggcagttccaatggcaatggaaagcaggctgtggctactggtgctgttgctgtacaagttgaagctgtggaggtcaagattgtctgtgctcagagttctgtggattcgtcctccggtgatagtttggagatgaaagccaagactggtcccagtagatgtgctacatgccggaaacgtgttggtttaactggtttcagctgcaaatgtggcaacctcttctgtgcaatgcatcgctattctgataaacatgaatgcccttttgattataggactgttggtcaggatgccatagctaaagccaacccgatagttaaggcagataagcttgacaaaatctag

SEQ ID NO: 299 - protein, 172 aa, Glycine max
MEPHDETGCQAPERPILCINNCGFFGRAATMNMCSKCYKDMLLKQEQDKFAASSVENIVNGSSNGNGKQAVATGAVAVQVEAVEVKIVCAQSSVDSSSGDSLEMKAKTGPSRCATCRKRVGLTGFSCKCGNLFCAMHRYSDKHECPFDYRTVGQDAIAKANPIVKADKLDKI

SEQ ID NO: 300 - DNA, 519 bp, Glycine max
atggcggaagaacaccgatgcgaaactcccgaaggtcacctactctgcgccaacaactgcggcttcttcggtagcaccgccacgatgaacctctgctcgaaatgctacggcgcgatccgcttgaaggagcaagaagaagcgtcgacgaaatctacaatcgaaaccgcgctctcttcttcctcgttgaaaccgtcgttctccacgtcacctccaacgttggtggatgtcctcatcgaatcgccgccgccgtctttggcggaggttgcggtcacggtggcggtggaggcgtcgagttctatttccacaagctcaggttcggttgcgcaaccgaaccggtgtgccacgtgtcggaagcgcgtggggctgaccgggttcaagtgcaggtgcggattgacgttctgcggggcccacaggtactcggagaagcacgcgtgcgggttcgattttaagacggtggggagagaggagattgcacgtgccaaccccgtgatcaaagcggagaagctgcggaggatttga

SEQ ID NO: 301 - protein, 172 aa, Glycine max
MAEEHRCETPEGHLLCANNCGFFGSTATMNLCSKCYGAIRLKEQEEASTKSTIETALSSSSLKPSFSTSPPTLVDVLIESPPPSLAEVAVTVAVEASSSISTSSGSVAQPNRCATCRKRVGLTGFKCRCGLTFCGAHRYSEKHACGFDFKTVGREEIARANPVIKAEKLRRI

SEQ ID NO: 302 - DNA, 483 bp, Glycine max
atggccgaagaacaccgatgccaagctcccgaaggtcacagactctgctccaacaactgcggcttcttcggtagccccgccacaatgaatctctgttccaaatgctacagagacatccgtttgaaggaagaagaacaagccaaaactaaatccacaatcgaaaccgctctttctggatcttcctccgccaccgtcgccgttgcctccgccgtggattctcttccggcgccggttgaatccctccctcaaccgtcggtggtgagttcgccagatgtggccgcaccggttcaggcgaaccggtgcggcgcgtgtaggaagcgcgtgggattgactgggtttaagtgcaggtgcggaaccacgttttgtgggactcaccggtaccccgagaaacacgcgtgtggcttcgatttcaaggcggtggggagagaggagatagcacgggcgaatcccgtgatcaaaggcgagaagctacggaggatttaa

SEQ ID NO: 303 - protein, 160 aa, Glycine max
MAEEHRCQAPEGHRLCSNNCGFFGSPATMNLCSKCYRDIRLKEEEQAKTKSTIETALSGSSSATVAVASAVDSLPAPVESLPQPSVVSSPDVAAPVQANRCGACRKRVGLTGFKCRCGTTFCGTHRYPEKHACGFDFKAVGREEIARANPVIKGEKLRRI

SEQ ID NO: 304 - DNA, 477 bp, Glycine max
atggcggaagaacacagatgccaggcaccgcgcttctgcgccaacaattgcggtttctttggcagccctgccacgcagaatatgtgctccaagtgctaccgcgatttccagctcaaggagcagcaatcttccaacgccaagatggttctcaatcagtcgctggttccttcaccgccaccggcggtgatttctcagccgtcgtcttcttcttcggccgcggtagatccgtcatcggcggtggttgatgacgcgccacgcgagtcggaggaggttaaggcgccgcagcagaaccggtgtatgacgtgcaggcggcgcgtggggctcacagggttcaagtgtcggtgcgggatgatgctgtgcgggacccaccgttacccggagcagcacgcgtgcgagttcgacttcaaggggatggggagagagcagatcgcgaaggcgaatccggtggtgaagggcgagaagctcgacaagatctga

SEQ ID NO: 305 - protein, 158 aa, Glycine max
MAEEHRCQAPRFCANNCGFFGSPATQNMCSKCYRDFQLKEQQSSNAKMVLNQSLVPSPPPAVISQPSSSSSAAVDPSSAVVDDAPRESEEVKAPQQNRCMTCRRRVGLTGFKCRCGMMLCGTHRYPEQHACEFDFKGMGREQIAKANPVVKGEKLDKI

SEQ ID NO: 306 - DNA, 534 bp, Glycine max
atggcggaagaacaccgatgtgaacctcccgaaggtcaccgactctgcgtcaacaactgcggcttcttcggtagcaccgccacgatgaacctctgctccaaatgctacagcgcgatccgtttgaaggagcaagaagaagcgtcgacgaaatccacaatcgaaaccgcgctctcttctgcctcctcggcgaaaccgtcgtcgtccacgtcacctccgccgtcggcggtcgatgtgctcatggaatctccaccgccgtctgcggcggaggttgaggttgctgtcacggtcacggtcgcggtggcgtcgagttctatttccataaactcaggttcggttgcgcaaccgaaccggtgtgccacgtgtcggaagcgcgtggggctgaccgggttcaagtgcaggtgcggagtgacgttctgcggggcccacaggtacccggaggagcacgcgtgcgggttcgatttcaagacagtgggaagagaggagattgcacgtgccaaccccgtgatcaaagcggagaagctgcggaggatttga

SEQ ID NO: 307 - protein, 177 aa, Glycine max
MAEEHRCEPPEGHRLCVNNCGFFGSTATMNLCSKCYSAIRLKEQEEASTKSTIETALSSASSAKPSSSTSPPPSAVDVLMESPPPSAAEVEVAVTVTVAVASSSISINSGSVAQPNRCATCRKRVGLTGFKCRCGVTFCGAHRYPEEHACGFDFKTVGREEIARANPVIKAEKLRRI

SEQ ID NO: 308 - DNA, 528 bp, Glycine max
atggaccatgacaagactgggtgccaagctcctcctgaaggtcctatattgtgcatcaacaactgtggattttttggaagtgcagctaccatgaatatgtgttctaaatgccacaaagacatgttgctgaaacaggagcaggccaagcttgcagcatcatccattgggaatattatgaatgggtcttcaagcagcactgaaaaggaacctgttgttgccgctgctgctgctaatgttgatatcccagttattccagtagagcctaaaactgtctctgtgcaacctttatttggttcaggtccagaagggagtggtgaggcaaagctgaaggatggaccaaaacgctgcagcagctgcaacaagcgagttggtttgacagggtttaattgtcgatgtggtgaccttttttgtgctgtacatcgctactcagacaagcataattgcccatttgattaccgcactgctgctcgggatgccatagctaaagcaaacccagttgtcaaggctgagaagcttgataagatctaa

SEQ ID NO: 309 - protein, 175 aa, Glycine max
MDHDKTGCQAPPEGPILCINNCGFFGSAATMNMCSKCHKDMLLKQEQAKLAASSIGNIMNGSSSSTEKEPVVAAAAANVDIPVIPVEPKTVSVQPLFGSGPEGSGEAKLKDGPKRCSSCNKRVGLTGFNCRCGDLFCAVHRYSDKHNCPFDYRTAARDAIAKANPVVKAEKLDKI

SEQ ID NO: 310 - DNA, 513 bp, Glycine max
atggagtctcacgatgagactggatgccaggctcctgaacgccccattctttgcattaataattgtggcttctttggaagagcagctaccatgaacatgtgttccaagtgttacaaggacatgctgttgaagcaggagcaggacaattttgcagcatcgtcggttgaaaacattgtgaatggcagttccaatggcaatggggctgtgactactggtgctgttgatgtacaagttgaagctgtggaggtcaagactgtctctgctcagagttctgtagattcatcctccggtgagagtttggagatgaaagccaagaacagtcccagtagatgcgctacatgccggaaacgtgttgggttaactggtttcagctgcaaatgtggcaacctcttctgtgcaatgcatcgctattctgataaacatgattgcccttttgattataggactgttggtcaggatgccatagctaaagccaaccccataattaaggcagataagctcgacaaaatctag

SEQ ID NO: 311 - protein, 170 aa, Glycine max
MESHDETGCQAPERPILCINNCGFFGRAATMNMCSKCYKDMLLKQEQDNFAASSVENIVNGSSNGNGAVTTGAVDVQVEAVEVKTVSAQSSVDSSSGESLEMKAKNSPSRCATCRKRVGLTGFSCKCGNLFCAMHRYSDKHDCPFDYRTVGQDAIAKANPIIKADKLDKI

SEQ ID NO: 312 - DNA, 495 bp, Glycine max
atggccgaagaacaccgatgccaagctcccgaaggtcacagactctgctccaacaactgcggtttctttggtagccccgccaccatgaatctctgttccaaatgctacagagacatccgtttgaaggaagaagaacaagccaaaaccaaatccacaatcgaaaccgctctttcaggatcttcctccgccaccgtcaccgcaaccgccgtcgttgcctcctccgtggaatccccttcggcgccggttgaatccctccctcaaccaccggtgctgatttcgccggatatagccgcaccggttcaggcgaaccggtgcggcgcgtgtaggaagcgcgtggggttgacagggttcaagtgcaggtgcggaacaacgttttgtgggagccacaggtaccccgagaaacacgcgtgtggcttcgatttcaaagcggtggggagagaggagatagcacgggcgaatcccgtgatcaaaggcgagaagctacggaggatttaa

SEQ ID NO: 313 - protein, 164 aa, Glycine max
MAEEHRCQAPEGHRLCSNNCGFFGSPATMNLCSKCYRDIRLKEEEQAKTKSTIETALSGSSSATVTATAVVASSVESPSAPVESLPQPPVLISPDIAAPVQANRCGACRKRVGLTGFKCRCGTTFCGSHRYPEKHACGFDFKAVGREEIARANPVIKGEKLRRI

SEQ ID NO: 314 - DNA, 495 bp, Glycine max
atggctcagaaaaccgagaaagaagaaaccgacttcaaggttcccgaaacgattacgctttgcgttaacaactgcggcgtcaccggaaaccctgctacgaataacatgtgtcagaagtgcttcaccgccttcaccacctctaccgccaccacgtccggcgccggaggtgccggaatagcttctccggctaccagatccggcatctccgcgcgtccactgaagagatcttttcccgaggagccctcgccgccggcggatcctccgtcttcagaccagacgaccccgtcggaggcgaagcgcgtggtgaaccgctgctccggctgcaggaggaaggtcggactcaccggatttcggtgccgatgcggcgagctcttctgcgccgagcaccggtactccgaccgccacgactgcagctacgactacaaagccgccggaagagaagccatcgcgagggagaatccggtgattagagccgcgaagatcgtcaaagtctga

SEQ ID NO: 315 - protein, 164 aa, Glycine max
MAQKTEKEETDFKVPETITLCVNNCGVTGNPATNNMCQKCFTAFTTSTATTSGAGGAGIASPATRSGISARPLKRSFPEEPSPPADPPSSDQTTPSEAKRVVNRCSGCRRKVGLTGFRCRCGELFCAEHRYSDRHDCSYDYKAAGREAIARENPVIRAAKIVKV

SEQ ID NO: 316 - DNA, 486 bp, Glycine max
atggctcagaaaaccgagaaagaagaaaccgacttcaaagttccggaaacgattacgctttgcgtcaacaactgcggcgtcaccggaaaccctgccacgaataacatgtgccagaagtgcttcactgcctctaccgccaccacttccggcgccggaggtgccggaatagcttctccggcgaccagatccggcgtctccgcgcgtcctcagaagagatcttttcctgaagagccctcgccggtggcggatcctccttcttcggaccagacgacgccgtcggaggcgaagcgcgtggtcaaccgctgctccggatgccggcggaaggtcggactcaccggattccggtgccggtgcggcgagctcttctgcgccgagcaccggtactccgaccgccacgactgcagctatgactacaaagccgccggaagagaagccatcgcgagggagaatccggtgatcagagctgcgaagatcgtcaaagtctga

SEQ ID NO: 317 - protein, 161 aa, Glycine max
MAQKTEKEETDFKVPETITLCVNNCGVTGNPATNNMCQKCFTASTATTSGAGGAGIASPATRSGVSARPQKRSFPEEPSPVADPPSSDQTTPSEAKRVVNRCSGCRRKVGLTGFRCRCGELFCAEHRYSDRHDCSYDYKAAGREAIARENPVIRAAKIVKV

SEQ ID NO: 318 - DNA, 492 bp, Hordeum vulgare
atggcgcagcgggaccacaagcaggaggagccgacggagctgcgggcgccggagatcacgctctgcgccaacagctgcggcttccccggcaacccggccacgcagaacctctgccagaactgcttcctggccggcccggcgtccacgtcgccgtcctcctcctcctcttccctaccgggcgcgtccgtgtcgacccccgtgctcgacaggccgaggcccgcgccggtggacgcggagctggcgcaccccgccgtcgactaccgcgctacggcgacggaggcgaagccggcgaggacgtcggtgaaccggtgctccagctgccggaagcgggtcgggctgacggggttccggtgccggtgcggcgacgtgttctgcggcgagcaccggtactcggaccggcatgggtgcagctacgactacaaggccgccgccagggacgccatcgcccgggacaaccccgtggtgcgcgccgccaagatcggcagggtctga

SEQ ID NO: 319 - protein, 163 aa, Hordeum vulgare
MAQRDHKQEEPTELRAPEITLCANSCGFPGNPATQNLCQNCFLAGPASTSPSSSSSSLPGASVSTPVLDRPRPAPVDAELAHPAVDYRATATEAKPARTSVNRCSSCRKRVGLTGFRCRCGDVFCGEHRYSDRHGCSYDYKAAARDAIARDNPVVRAAKIGRV

SEQ ID NO: 320 - DNA, 567 bp, Physcomitrella patens
atggccaccgagcgtgtgtctcaggagacgacctcgcaggcccctgagggtccagttatgtgcaagaacctttgcggcttcttcggcagccaagctaccatggggttgtgctcgaagtgctaccgagagacagtcatgcaagcgaagatgacggctttagctgagcaagccactcaggctgctcaggcgacatctgccacagctgctgctgttcagccccccgctcctgtacatgagaccaagctcacatgcgaggttgagagaacaatgattgtgccgcatcaatcttccagctatcaacaagacctggttacccccgctgcagctgcccctcaggcagtgaagtcctctatcgcagctccctctagacccgagcccaatcgatgcggatcttgcaggaagcgtgttggattgacaggatttaagtgtcgctgtggcaacctctactgcgctttacatcggtactcggacaaacacacttgcacatatgactacaaagccgcagggcaggaagcgattgcgaaagctaatcctcttgtcgtggccgagaaggttgtcaagttttga

SEQ ID NO: 321 - protein, 188 aa, Physcomitrella patens
MATERVSQETTSQAPEGPVMCKNLCGFFGSQATMGLCSKCYRETVMQAKMTALAEQATQAAQATSATAAAVQPPAPVHETKLTCEVERTMIVPHQSSSYQQDLVTPAAAAPQAVKSSIAAPSRPEPNRCGSCRKRVGLTGFKCRCGNLYCALHRYSDKHTCTYDYKAAGQEAIAKANPLVVAEKVVKF

SEQ ID NO: 322 - DNA, 567 bp, Physcomitrella patens
atggccaccgagcgtgtcacacaggagacaacctcccagacccccgaggggcctgtgatgtgtaagaacgtgtgcggtttctttggcagccaagccactatgggtctctgctcgaagtgttacagggagaccgtcatgcaagcgaagatgaccgccgtggccgagcaggccactcaagccgctcaggtgctgccatccgctgcatccagtgctcagcctccagttcttatggaagaggacaagagctcatttgaggccgacagcatgttgatacaaccgcctcaatcttccagccaccatccagttgaggttgctccggttacagtagccccccaggttgtagttgcccccgttgccacaccctccagaccggcaccaaaccggtgcggatcttgcaggaagcgcgtgggattgacaggatttcagtgtcgttgtgggcaccttttttgtgctttacatcggtattctgacaaacatagttgcacttatgattacaaggctgctggacaggaggctattgcaaaggctaatcctttagttgtggccgagaaggttgttaagttctga

SEQ ID NO: 323 - protein, 188 aa, Physcomitrella patens
MATERVTQETTSQTPEGPVMCKNVCGFFGSQATMGLCSKCYRETVMQAKMTAVAEQATQAAQVLPSAASSAQPPVLMEEDKSSFEADSMLIQPPQSSSHHPVEVAPVTVAPQVVVAPVATPSRPAPNRCGSCRKRVGLTGFQCRCGHLFCALHRYSDKHSCTYDYKAAGQEAIAKANPLVVAEKVVKF

SEQ ID NO: 324 - DNA, 534 bp, Tagetes erecta
atgggatctgagtccaacaagatgaacgacggtacaagcttccaaccgtcggagccatctccatgcgccaacggttgtggctttttcggtaccgccgctacaaacggatactgttcaaagtgcttccgtgacatcagagttcacgaagaacaagcagcatccgctatagcggcggttgataagcttgttaacaaggttgttaacttcactccaccgccaccgtctccttcttccagttccggatccggacttgtaatatccggatccgaaactggatccagatctgaacctggaccgacgctagaaccaaacagctctacggtggtccaggtgaaaaaggcatctaatagatgcttgacgtgtaataaaaaagtaggtgtgatgggatttaagtgtaggtgtggggatacgttttgtgggagccataggtacccggagaaacatgagtgtgagtttgattttaagaaaagtggtcgagatgcgatagctaaagctaacccggtgattaaagctgataaggttgatcggatctga

SEQ ID NO: 325 - protein, 177 aa, Tagetes erecta
MGSESNKMNDGTSFQPSEPSPCANGCGFFGTAATNGYCSKCFRDIRVHEEQAASAIAAVDKLVNKVVNFTPPPPSPSSSSGSGLVISGSETGSRSEPGPTLEPNSSTVVQVKKASNRCLTCNKKVGVMGFKCRCGDTFCGSHRYPEKHECEFDFKKSGRDAIAKANPVIKADKVDRI

SEQ ID NO: 326 - DNA, 498 bp, Triticum aestivum
atggcgcagcgggatcacaagcaggaggagcccacggagctgcgggcgccggagatcacgctctgcgccaacagctgcggcttcccgggcaacccggccacgcagaacctctgccagaactgcttcttggccggcccggcgtccacgtcgccgtcttcctcctcctcctcctcctcttctctgccgggcgtgtccgcgccgacccccgtcatcgacaggccgaggccggcgccgttggaggcggagctggcacgccccgccgtcgaccttgctccggcgacggaggcgaagccggcgaggacgtcggtgaaccggtgctccagctgccggaagcgcgtggggctgacggggttccggtgccggtgcggcgacatgttctgcggcgagcaccggtactcggaccggcacgggtgcagctacgactacaaggccgccgccagggacgccatcgccagggacaaccccgtcgtgcgcgccgccaagatcgtcaggttctga

SEQ ID NO: 327 - protein, 165 aa, Triticum aestivum
MAQRDHKQEEPTELRAPEITLCANSCGFPGNPATQNLCQNCFLAGPASTSPSSSSSSSSSLPGVSAPTPVIDRPRPAPLEAELARPAVDLAPATEAKPARTSVNRCSSCRKRVGLTGFRCRCGDMFCGEHRYSDRHGCSYDYKAAARDAIARDNPVVRAAKIVRF

SEQ ID NO: 328 - DNA, 459 bp, Zea mays
atggcggaggagcagcagcatcagagatggcaggagggccaccgcctgtgcgccaacaattgcggcttcttcggcagccccgcgacgctggacctctgctccaagtgctaccgcgacctataccagcagcagccagcaggcgcggcggcgggcccctccgctcccaccgcgtcggccttccagcattcctcctcggcagtctccggcgcggcggcggtctctcccgatctcgaacctcccgcgacggcccctgctggcgccaaggcgggcaggtgctccagctgccggaagcgcgtgggcctgacggggttcgcgtgccgctgcggagctaccttctgcggcgtgcaccgctacccggagcggcacgcgtgcgccttcgatttccgggccgccggccgcgacgccatcgcgcgcgccaaccccgtcgtcaagggcgataagctcaaggacaagatctga

SEQ ID NO: 329 - protein, 152 aa, Zea mays
MAEEQQHQRWQEGHRLCANNCGFFGSPATLDLCSKCYRDLYQQQPAGAAAGPSAPTASAFQHSSSAVSGAAAVSPDLEPPATAPAGAKAGRCSSCRKRVGLTGFACRCGATFCGVHRYPERHACAFDFRAAGRDAIARANPVVKGDKLKDKI

SEQ ID NO: 330 - DNA, 492 bp, Zea mays
atggcgcagcgcgacaagaaggaggagcccacggagctccgggcgccggagatcacgctgtgcgccaacaactgcgggttcccgggtaacccggccacgcagaacctgtgccagagctgcttctcggcgtcgaggtcgccgtcgtcccctacctcctcctcctcttccctggcgtccgcggcgtcgcagccgaggccagcagcgctcgtcgtagacgcggcagcggtggaggcgctggccgctccggcggccgtggccgccgccgcgggccaggctacggaagccgcggcgagggcgtccgcgagccggtgctccagctgccggaagcgcgtggggctcacggggttccggtgccgctgcggcgagctcttctgcggcgcgcaccggtactcggaccggcacggctgcagctacgactacaagggcgccgcccgggacgccatcgcccgggagaacccggtggtgcgcgcggccaaggtggttaggttctga

SEQ ID NO: 331 - protein, 163 aa, Zea mays
MAQRDKKEEPTELRAPEITLCANNCGFPGNPATQNLCQSCFSASRSPSSPTSSSSSLASAASQPRPAALVVDAAAVEALAAPAAVAAAAGQATEAAARASASRCSSCRKRVGLTGFRCRCGELFCGAHRYSDRHGCSYDYKGAARDAIARENPVVRAAKVVRF

SEQ ID NO: 332 - DNA, 699 bp, Zea mays
atgtgctccaagtgccacaaggagatgataatgaagcaggagcaggcccagttggctgcctcctccatcgatagcattgtcaattgcaggtcctttcccatttcgaagctcctcctcgcgattccaatccacgcacgccatctccgactccgcgtccgcctcgcgcaggacatatattcagtgatggaacacaaggaggccggctgccagcagccggagggcccaatcctatgcatcaataactgtggtttctttggaagcgctgccaccatgaacatgtgctccaagtgccacaaggagatgataatgaagcaggagcaggcccagttggctgcctcctccatcgatagcattgtcaatggcggtgataatgggaaaggacctgcaattgctgcaactgtaggtgtggcagttcctcaagtcgaggagaagactatcgccgtgcagcctatgcatgtcgctgaaaccagcgaggctgctgctgttatcgcgaaggccaaggaaggcccaaaccggtgcgcaacctgtaggaagcgtgttgggttgacgggttttaactgccgatgcgggaacacgtactgttcgatgcaccgctactccgacaaacacgactgccagttcgactatcgaactgcagctagggacgctatcgccaaggccaatccagtggtgaaggcggagaagcttgacaagatctga

SEQ ID NO: 333 - protein, 171 aa, Zea mays
MEHKEAGCQQPEGPILCINNCGFFGSAATMNMCSKCHKEMIMKQEQAQLAASSIDSIVNGGDNGKGPAIAATVGVAVPQVEEKTIAVQPMHVAETSEAAAVIAKAKEGPNRCATCRKRVGLTGFNCRCGNTYCSMHRYSDKHDCQFDYRTAARDAIAKANPVVKAEKLDKI

SEQ ID NO: 334 - DNA, 531 bp, Zea mays
atggctcagcgcgacaagaaggtggaggagccgacggagctgcgcgcgccggagctcacgctgtgcgccaacagctgcggcttcccgggcaacccggccaccaacaacctctgccaggcctgcttcctggccgccacggcttcctcctccgcctccgcctccgtctcgccgccgccgccctcctcctcctcctcgtcgccggcggtgctccagttcgacgagcagcagcagcagcaaaatccgaggccgcgtgcgccggcggcgtccgggcccacggaggaaccgcccaggccggcccgggcgtcagctccggctccggctccggcgtcgtcctcgtccgtccgccggtgccagacctgccgcaagcgggtggggctcacgggcttccgctgccgctgcggagacctcttctgcggcgcgcaccgctactcggaccgccacgactgctgcttcgactacagggccgccggccgcgacgccatcgccagggacaaccccgtcgtgcgcgccgccaagatcgttaggttctag

SEQ ID NO: 335 - protein, 176 aa, Zea mays
MAQRDKKVEEPTELRAPELTLCANSCGFPGNPATNNLCQACFLAATASSSASASVSPPPPSSSSSSPAVLQFDEQQQQQNPRPRAPAASGPTEEPPRPARASAPAPAPASSSSVRRCQTCRKRVGLTGFRCRCGDLFCGAHRYSDRHDCCFDYRAAGRDAIARDNPVVRAAKIVRF

SEQ ID NO: 336 - DNA, 516 bp, Zea mays
atggaacacaaggaggcgggctgccagcagccggagggcccaatcctatgcatcaataactgcggcttcttcggcagtgctgcgacgatgaacatgtgctccaagtgccacaaggagatgataacgaagcaggagcaggcccagctggctgcctcctccatcgatagcattgtcaatggcggtgacggcgggaaaggacctgtaattgctgcatctgtaaatgtggcagttcctcaagttgagcagaagactattgttgtgcagcccatgcttgtagctgaaaccagcgaggctgctgctgtaatccccaaggccaaggaaggcccagaccggtgcgcggcctgcaggaagcgtgttgggctgacgggatttagctgccgatgcgggaacatgtactgttcggtgcaccgctactccgacaaacatgactgtcagttcgactatcggactgcagcaagggacgcgattgccaaggccaatcctgtggtgagggcggagaagctcgacaagatctga

SEQ ID NO: 337 - protein, 171 aa, Zea mays
MEHKEAGCQQPEGPILCINNCGFFGSAATMNMCSKCHKEMITKQEQAQLAASSIDSIVNGGDGGKGPVIAASVNVAVPQVEQKTIVVQPMLVAETSEAAAVIPKAKEGPDRCAACRKRVGLTGFSCRCGNMYCSVHRYSDKHDCQFDYRTAARDAIAKANPVVRAEKLDKI

SEQ ID NO: 338 - protein, 22 aa, Artificial sequence
  A20 zinc finger domain comprised in SEQ ID NO: 213
LCTNNCGVTANPATNNMCQKCF

SEQ ID NO: 339 - protein, 22 aa, Artificial sequence
  A20 zinc finger domain comprised in SEQ ID NO: 215
LCIKNCGVVGNPSTNNMCQNCF

SEQ ID NO: 340 - protein, 61 aa, Artificial sequence
  AN1 zinc finger domain comprised in SEQ ID NO: 213
RCSGCRKKVGLTGFRCRCGELFCSEHRYSDRHDCSYDYKTAGREAIARENPVVKAAKMVKV

SEQ ID NO: 341 - protein, 61 aa, Artificial sequence
  AN1 zinc finger domain comprised in SEQ ID NO: 215
RCSGCRRKVGLAGFRCRCGELFCADHRYSDRHDCGYDYKKVGREEIARENPVIRAAKIVKV

SEQ ID NO: 342 - DNA, 2194 bp, Oryza sativa; identical to SEQ ID NO: 128

SEQ ID NO: 343 - DNA, 54 bp, Artificial sequence
  primer: prm09483
ggggacaagtttgtacaaaaaagcaggcttaaacaatggctcagagaacggaga

SEQ ID NO: 344 - DNA, 50 bp, Artificial sequence
  primer: prm09484
ggggaccactttgtacaagaaagctgggtaacggttgagatcgaattttt

SEQ ID NO: 345 - DNA, 56 bp, Artificial sequence
  primer: prm09485
ggggacaagtttgtacaaaaaagcaggcttaaacaatggctcaaagaacagaaaat

SEQ ID NO: 346 - DNA, 49 bp, Artificial sequence
  primer: prm09486
gggaccactttgtacaagaaagctgggtttgaatttttgcttttcacac

SEQ ID NO: 347 - DNA, 738 bp, Lycopersicon esculentum
atggctaccaactcttcctcccatagccctcgcaccgtcgaggagatcttcaaagacttctccgcccgtcacgccgccgtcctccgtgccctcactacagatgtggaggatttttactcacagtgcgatccagagagagacaatttgtgtttgtatggacatccgaatgagtcttgggaagttgctgttccggccgaggaagttccgccggagttaccggagccggtgttaggtatcaattttgctagggatgggatggagcgtagagactggttgtctttggttgctatgcacacagattcgtggctgctctctgtcgctttctactttggtgctcgcttaaacagaaatgaaaggagtcgtgtgtttaccctgataaatgatctaccaactgtctttgaagccgtgacagggaggaagcctttaaaggacaaacctagtgttgatagtggaaagaaatcaaagaacaatgcaaagagagaaaaacaaatgaaagcaaatcaaaggctgcaagaggagagtgatgatgaggatgaagggaatgaagatgagcatgaagaaactctatgtggaagttgtggaacaaatggcaatgaggatgagttctggattggctgtgatatatgtgaaaagtggtatcatggcaagtgtgtgaaaataactcctgcaaaggctcaaagtatcaaggaatacagatgtccttcatgcagcaataaaagggcaaaacatatggcttga

SEQ ID NO: 348 - protein, 245 aa, Lycopersicon esculentum
MATNSSSHSPRTVEEIFKDFSARHAAVLRALTTDVEDFYSQCDPERDNLCLYGHPNESWEVAVPAEEVPPELPEPVLGINFARDGMERRDWLSLVAMHTDSWLLSVAFYFGARLNRNERSRVFTLINDLPTVFEAVTGRKPLKDKPSVDSGKKSKNNAKREKQMKANQRLQEESDDEDEGNEDEHEETLCGSCGTNGNEDEFWIGCDICEKWYHGKCVKITPAKAQSIKEYRCPSCSNKRAKHMA

SEQ ID NO: 349 - DNA, 759 bp, Arabidopsis thaliana
atggaaggaattcagcatcctatacctcgcactgtcgaagaggtttttagcgactttcgtggtcgtagagctggtctcatcaaggctctctctactgatgtacagaagttttaccatcagtgtgaccctgagaaggaaaacttgtgtctttatggacttccaaatgagacatgggaggttaatcttcccgttgaggaggtccctcctgagcttcctgaaccagcgttaggcatcaatttcgcaagggacggaatgcaagaaaaagactggatttctttggttgcagttcacagtgattcatggcttatctctgttgcattttactttggtgcacgtttcggatttggcaagaatgagaggaagaggctcttccagatgataaatgatctcccaaccattttcgaggttgtaactggcaatgcaaagcaatccaaggatcaatctgctaaccacaacagtagcagaagcaaatctagtggtggcaagcctcgtcattctgaatctcacactaaggcttcaaagatgtcccctccaccaagaaaagaagatgagagcggagatgaggatgaagatgacgagcaaggtgctgtttgtggtgcgtgtggcgacaactatggaggagatgagttctggatatgttgtgatgcttgcgagaaatggttccatgggaaatgcgtgaagatcacaccagcaaaggctgagcatatcaaacattacaaatgcccaagttgcactaccagcaagaaaatgaaagcctga

SEQ ID NO: 350 - protein, 252 aa, Arabidopsis thaliana
MEGIQHPIPRTVEEVFSDFRGRRAGLIKALSTDVQKFYHQCDPEKENLCLYGLPNETWEVNLPVEEVPPELPEPALGINFARDGMQEKDWISLVAVHSDSWLISVAFYFGARFGFGKNERKRLFQMINDLPTIFEVVTGNAKQSKDQSANHNSSRSKSSGGKPRHSESHTKASKMSPPPRKEDESGDEDEDDEQGAVCGACGDNYGGDEFWICCDACEKWFHGKCVKITPAKAEHIKHYKCPSCTTSKKMKA

SEQ ID NO: 351 - DNA, 741 bp, Arabidopsis thaliana
atggccgccgcagccgtttcctctaaccctcgcaccgttgaagagatcttcaaagattattccgctcgtcgtgccgctcttcttcgtgctctcactaaagatgttgatgatttttactctcaatgcgatccggaaaaggagaatttgtgtttgtacggacaccctaatgagtcatgggaagtgaatctaccagcagaggaagtgcctccggagctacctgagcctgctcttggtatcaatttcgctagagatggtatgcagaggaaagattggctttctcttgttgctgttcacagtgattgttggttgctctctgtttctttctactttggagcccgtcttaatcgcaatgagaggaagcggttattcagtctgatcaacgatctcccaactctcttcgatgtagtgactggtaggaaagccatgaaagacaacaagccaagctcggactcaggaagcaaatccagaaatggcactaagagatcaatagacgggcagacaaagagctcaacaccgaaactaatggaagagagctatgaggaggaggaagaagaagacgagcatggagacactctctgtggaagctgtggaggtcattacacaaatgaggagttctggatttgctgtgatgtttgtgaacgttggtaccatggaaaatgcgtcaagataactccggctaaagcagagagcatcaagcagtataaatgcccgccttgctgtgcaaagaaaggaagacagtga

SEQ ID NO: 352 - protein, 246 aa, Arabidopsis thaliana
MAAAAVSSNPRTVEEIFKDYSARRAALLRALTKDVDDFYSQCDPEKENLCLYGHPNESWEVNLPAEEVPPELPEPALGINFARDGMQRKDWLSLVAVHSDCWLLSVSFYFGARLNRNERKRLFSLINDLPTLFDVVTGRKAMKDNKPSSDSGSKSRNGTKRSIDGQTKSSTPKLMEESYEEEEEEDEHGDTLCGSCGGHYTNEEFWICCDVCERWYHGKCVKITPAKAESIKQYKCPPCCAKKGRQ

SEQ ID NO: 353 - DNA, 753 bp, Arabidopsis thaliana
atggaaggtggagctgctctctacaatcctcgaactgtcgaagaagttttcaaggatttcaaaggtcgtcgtactgccattgtcaaagctctcaccaccgatgttcaagagttttaccaacaatgtgaccctgagaaggagaatctttgcttgtatgggttaccgaatgaagaatgggaagtgaatttaccagctgaagaagtgcctcctgagttaccagagccagctcttggtattaactttgctagggatgggctctctgaaaaggaatggctttcgcttgttgctattcacagtgacgcttggttactgtctgtctcgttttactttggctcaaggttttctttccacaaggaagagaggaagcgtttgttcaacatgatcaatgatgttcctactatatttgaagtagtgactggaatggctaaagcaaaggacaagtcatctgctgcaaatcaaaacggaaacaaatccaagtctaactctaaagttagaacttcagagggaaaaagctcaaagaccaagcagccaaaagaggaggacgaagaaatagatgaagatgatgaggatgaccacggggaaaccctttgtggagcctgtggagacagtgatggtgctgatgaattctggatctgctgtgacctttgtgagaagtggttccatggcaagtgtgtgaagatcactccagctagagctgagcatatcaaacaatacaagtgcccttcatgcagcaacaaaagagctcgagcttaa

SEQ ID NO: 354 - protein, 250 aa, Arabidopsis thaliana
MEGGAALYNPRTVEEVFKDFKGRRTAIVKALTTDVQEFYQQCDPEKENLCLYGLPNEEWEVNLPAEEVPPELPEPALGINFARDGLSEKEWLSLVAIHSDAWLLSVSFYFGSRFSFHKEERKRLFNMINDVPTIFEVVTGMAKAKDKSSAANQNGNKSKSNSKVRTSEGKSSKTKQPKEEDEEIDEDDEDDHGETLCGACGDSDGADEFWICCDLCEKWFHGKCVKITPARAEHIKQYKCPSCSNKRARA

SEQ ID NO: 355 - DNA, 783 bp, Arabidopsis thaliana
atggaaggaggaactgcgcactacagccctcgaactgtcgaagaagtctttcgagattttaagggccgtcgagctggcatcatccaagctctcaccactgatgtggaagattttttccagcaatgcgaccctgagaagcagaatctctgcttgtatggattcccaaatgaagtgtgggaagttaacttaccagctgaagaagtgcctcctgagcttcccgaacctgcactcggcattaactttgccagagatgggatgcaggaaagaaactggctttctctcgttgctgtccacagtgatgcgtggttactttctgtgtctttttactttggttcaagatttggtttcgatagagctgacaggaagcgcttgtttagtatgataaatgaggttcctactgtatatgaagttgtaactggaaatgcagagaagcaaacaaaggaaatgccctcttcagcaaatcaaaatggcaacagatccaagtcaaattcaaaaatgagaggtttagaaagtaaaagttcaaagacgatacatgccaaggatgaggaagaaggattagagttagaagaaggggaagaggaagaggatgaggatgaagacgaacacggtgaaaccctatgtggagcatgtggagataactatgcttctgatgaattctggatttgctgtgacatgtgcgagaaatggttccacggggagtgtgtgaagatcactccagctagagcggagcatatcaagcattacaagtgccctacttgcagcaacaaaagagcacgaccctag

SEQ ID NO: 356 - protein, 260 aa, Arabidopsis thaliana
MEGGTAHYSPRTVEEVFRDFKGRRAGIIQALTTDVEDFFQQCDPEKQNLCLYGFPNEVWEVNLPAEEVPPELPEPALGINFARDGMQERNWLSLVAVHSDAWLLSVSFYFGSRFGFDRADRKRLFSMINEVPTVYEVVTGNAEKQTKEMPSSANQNGNRSKSNSKMRGLESKSSKTIHAKDEEEGLELEEGEEEEDEDEDEHGETLCGACGDNYASDEFWICCDMCEKWFHGECVKITPARAEHIKHYKCPTCSNKRARP

SEQ ID NO: 357 - DNA, 726 bp, Arabidopsis thaliana
atggccgctgagtcttctaaccctcgcaccgtcgaagagatcttcaaggattttagcggtcgtcgctccggttttcttcgagctctctccgtagatgttgacaagttctactctttatgcgatccggaaatggagaatctgtgtttgtacggacacccgaatgggacatgggaagtgaatcttccagctgaggaagtgcctccggagctacctgagccagctcttggaatcaatttcgctagagatggtatgcagcgtaaagattggctctctttagttgctgtccacagtgattgttggttactctctgtttcttcttacttcggcgctcgtcttaatcgcaatgagaggaaacgtctatttagtctgatcaacgatctcccaactctctttgaagtagtgacgggtaggaaacccatcaaagacggtaaaccaagcatggatctcggaagcaaatccagaaacggcgtaaagagatcaattgaagggcagacaaagagcacgccgaaactaatggaagagagctatgaagatgaagacgatgagcatggagacacactctgtggaagttgtggaggaaactacacaaacgacgagttctggatatgttgtgatgtgtgtgaacgttggtaccatgggaagtgtgtgaagataacaccagccaaagcagagagcatcaagcaatacaaatgcccttcttgctgcactaagaaaggaagacagtga

SEQ ID NO: 358 - protein, 241 aa, Arabidopsis thaliana
MAAESSNPRTVEEIFKDFSGRRSGFLRALSVDVDKFYSLCDPEMENLCLYGHPNGTWEVNLPAEEVPPELPEPALGINFARDGMQRKDWLSLVAVHSDCWLLSVSSYFGARLNRNERKRLFSLINDLPTLFEVVTGRKPIKDGKPSMDLGSKSRNGVKRSIEGQTKSTPKLMEESYEDEDDEHGDTLCGSCGGNYTNDEFWICCDVCERWYHGKCVKITPAKAESIKQYKCPSCCTKKGRQ

SEQ ID NO: 359 - DNA, 696 bp, Chlamydomonas reinhardtii
atgagtcgttcacctcgtgccatctatgaagactatgttgggcggcgcaaaggcatcctgcgcgcactgacgaccgacatcgaccgcttctggtcacaatgcgaccctcaaaaggagaacctctgcctgtacgcataccaggacgggacgtgggcgtgcgacctgcccgctgaggaagttccacctgaggcgccagagccagccttgggcatcaactttgctcgtgatggcatggagcgcaaggactggatcagcctagtcgccgtgcactcggacagttggctgctggcgctggcgttctacaagggagcgcggctcaaccgggacgagcgggatgagctgtttggcctcataaacaaactaccgacgtgctacgaggtggtctcgggccgcgtcaagcagacgaacggggggccaacgacgaacgctggcggcatgaagcggccgggaggccccggcgggccgtcgcgcgcttcagcgcgggcaagggcggacgagggcggggccagtggcgattgggaggacggcgagggtgacccctgcccggcctgcgggcgcctgtatcgcacggatgagttctggatcgcctgcgacgcttgcgacacgtggtactgtgggcgctgcgcgaagatgacggaaaagaaggcagcgcagatgaagcactggcgctgtggccagtgcgccggcccgcaatga

SEQ ID NO: 360 - protein, 231 aa, Chlamydomonas reinhardtii
MSRSPRAIYEDYVGRRKGILRALTTDIDRFWSQCDPQKENLCLYAYQDGTWACDLPAEEVPPEAPEPALGINFARDGMERKDWISLVAVHSDSWLLALAFYKGARLNRDERDELFGLINKLPTCYEVVSGRVKQTNGGPTTNAGGMKRPGGPGGPSRASARARADEGGASGDWEDGEGDPCPACGRLYRTDEFWIACDACDTWYCGRCAKMTEKKAAQMKHWRCGQCAGPQ

SEQ ID NO: 361 - DNA, 762 bp, Glycine max
atggactctcgcacgtataatcctcgcaccgtcgaagaggtttttagggatttcaagggccgaagagctggtctcatcaaagccctaaccaccgatgttgaagatttctacaaccaatgtgatcctgagaaggagaatttgtgcttgtatggctttcccagtgagcagtgggaagtaaatttacctgctgaagaagtaccaccagagcttcctgagcccgtactgggcattaactttgctagggatggcatgcaagaaaaagactggctatctttagttgctgttcatagtgatgcatggttgcttgctattgcattctattttggagccagatttgggtttgataaagctgacaggaaacggcttttcaacatgatcaatgaactgccaacaatatttgaagttgttactggtgcagcaaaaaagcaagttaaggagaagtcttcagtttcaaaccacagtggcagcaagtctaagtccagctctaaggcacagcgggctccagaatctcagagtagacagtcaaagccattgcaaccaaaagatgaggatgaagaactggacgatcaagatgatgatgaacatggagagaccttgtgtggggcatgtggtgagcactatggcactgatgaattctggatttgctgtgacatctgcgagaagtggttccatggtaaatgtgtgaagatcacccctgctagggcagagcatatcaagcaatacaagtgcccatcttgcagtaacaagagagctcggccctga

SEQ ID NO: 362 - protein, 253 aa, Glycine max
MDSRTYNPRTVEEVFRDFKGRRAGLIKALTTDVEDFYNQCDPEKENLCLYGFPSEQWEVNLPAEEVPPELPEPVLGINFARDGMQEKDWLSLVAVHSDAWLLAIAFYFGARFGFDKADRKRLFNMINELPTIFEVVTGAAKKQVKEKSSVSNHSGSKSKSSSKAQRAPESQSRQSKPLQPKDEDEELDDQDDDEHGETLCGACGEHYGTDEFWICCDICEKWFHGKCVKITPARAEHIKQYKCPSCSNKRARP

SEQ ID NO: 363 - DNA, 759 bp, Glycine max
atggacggtggtggagtgaactacaaccctcgcaccgtggaacaggttttccgggacttcaagggccgtagagctggcatgatcaaggctctcaccactgatgttgaagaatttttccagcagtgcgatcctgaaaaggataatctttgtctgtacggattccctaatgagcaatgggaagttaatttacctgcggaagaagttcctccggagcttcctgagcctgcattgggcataaactttgctagggatgggatgcaagacaaggactggctgtctttggttgccgttcacagcgatgcatggttacttgcagtggctttctactttggggcacgatttggttttgataatgctgacaggaaacgcctgttctctatgattaatgatttaccaacaatatttgagattgtgactggaagcgcaaaaaaacagacgaaggaaaaatcatccatttcaaaccacagcagtaacaaatcaaaatctggttcaaaagggcgaggatctgaatcagggaagtattcaaaggaaacaaaggacgaggaggaagaggtactggatgaagaagatgacgaggagcatgaggagaccttgtgtggggcatgtggggagcactatgcatccgatgagttctggatttgttgcgacatatgtgagaagtggttccatggcaagtgtgtgaagatcactccagccagggccgaacacatcaagcagtataagtgcccctcatgcagcaataagagagcacggccttga

SEQ ID NO: 364 - protein, 252 aa, Glycine max
MDGGGVNYNPRTVEQVFRDFKGRRAGMIKALTTDVEEFFQQCDPEKDNLCLYGFPNEQWEVNLPAEEVPPELPEPALGINFARDGMQDKDWLSLVAVHSDAWLLAVAFYFGARFGFDNADRKRLFSMINDLPTIFEIVTGSAKKQTKEKSSISNHSSNKSKSGSKGRGSESGKYSKETKDEEEEVLDEEDDEEHEETLCGACGEHYASDEFWICCDICEKWFHGKCVKITPARAEHIKQYKCPSCSNKRARP

SEQ ID NO: 365 - DNA, 741 bp, Glycine max
atggaggcgctaagtcgctccgtggaagacgtattcgaggatttcaagggccggagagccggcatcatcaaagctcttaccaccgatgttgaagatttctacagccaatgtgatcctgagaaggagaatttgtgcttatatggatcacctaatgagcaatgggaagtaaatttacctgttgaagaagttcctccagagcttcctgagcctgtcctgggcattaactttgctagggatggcatgcaggaaaaagactggttatctttagttgctgttcatagtgatacatggttacttgcccttgccttttattttggagccagatttggatttgataaaactcacaggaatcgactattcagtatgatcaatgaactaccaacaatatttgaagttgttacagcaaagaaacaagttaaagagaagtcttcggtttcaaacaacagtggcagcaaatctaagtctaactctaaagcgcgggcttccgaaacccagggcagacaatcaaagccattacaaccaaaagatgaggatgaaggactagaagaggaagataatgatgaacatggagataccttgtgtggggcatgtagtgagaattatggtaccgatgagttctggatttgctgcgacatctgtgagaagtggttccatggaaaatgtgtgaagatcacccctgccagagcagagcatatcaagcaatacaagtgcccatcatgcagtaacaagagagctcgctaa

SEQ ID NO: 366 - protein, 246 aa, Glycine max
MEALSRSVEDVFEDFKGRRAGIIKALTTDVEDFYSQCDPEKENLCLYGSPNEQWEVNLPVEEVPPELPEPVLGINFARDGMQEKDWLSLVAVHSDTWLLALAFYFGARFGFDKTHRNRLFSMINELPTIFEVVTAKKQVKEKSSVSNNSGSKSKSNSKARASETQGRQSKPLQPKDEDEGLEEEDNDEHGDTLCGACSENYGTDEFWICCDICEKWFHGKCVKITPARAEHIKQYKCPSCSNKRAR

SEQ ID NO: 367 - DNA, 765 bp, Glycine max
atggaggcaggttacaatcctcgtaccgtcgaagaggtctttagggatttcaagggtcgcagagctgctttgattaaagccctcaccaccgatgttgaagagttctaccagcagtgcgatcccgagaaggaaaatctttgcctttatggatttccaagtgagcagtgggaagtcaatctgccagctgaggaggtgccccctgagcttccagagccagcattgggcattaactttgccagagacgggatgcaagaaaaggactggctgtctttggttgctgtacacagtgatgcttggttgcttgctgtggctttttattttggtgctaggtttggatttgacgaggctgataggaagcgactatttaatatgataaatgatcttccgacaatatttgaggttgttacagggatggccaagaaacaaggaaaggaaaagtcatcagtttcaaatcatagcagtaccaaatctaagtcaaactctaagcgaggttctgaatcaaagtatacaaaagcaatgcaatcaaaggacgaggatgatgagggtggtgtgggtttgggtttggaagacgaagacgaagaggaacatggagataccttgtgtggggcatgtggagagagctatgctgctgatgagttctggatttgctgcgacatctgcgagaaatggttccatggaaagtgcgtgaagattacccctgcaagggctgagcatatcaagcagtacaaatgtccttcttgcagcaacaagcgagctcgaccttga

SEQ ID NO: 368 - protein, 254 aa, Glycine max
MEAGYNPRTVEEVFRDFKGRRAALIKALTTDVEEFYQQCDPEKENLCLYGFPSEQWEVNLPAEEVPPELPEPALGINFARDGMQEKDWLSLVAVHSDAWLLAVAFYFGARFGFDEADRKRLFNMINDLPTIFEVVTGMAKKQGKEKSSVSNHSSTKSKSNSKRGSESKYTKAMQSKDEDDEGGVGLGLEDEDEEEHGDTLCGACGESYAADEFWICCDICEKWFHGKCVKITPARAEHIKQYKCPSCSNKRARP

SEQ ID NO: 369 - DNA, 759 bp, Glycine max
atggaaggagtaccgcacccaatacccagaactgtcgaagaggttttcaccgattttaagggcagacgcgctggtttgattaaggccctcactactgacgttgaaaagttttaccagcagtgcgatcccgagaaggagaatttgtgtctatatgggtttccaaatgaaacatgggaagtgaatttgcctgttgaggaagtgcctcctgaacttcctgagccagcattaggtataaactttgccagggacggcatgcaagagaaggactggctatcactggttgcagttcacagtgactcatggctgcttgctgttgctttctattttggtgcccgctttggatttggtaagaatgaaaggaaaaggctttttcagatgataaatgatctgccaacaatcttcgaacttgtgacaggaagtgctaagcaatcaaaggatcaaccagctgctcacaacaatggtagcaaatgcaaatcaagtggaaagtcccatcagtctgagtctcaggccaaggggatgaagatgtctgcaccacccaaagaagaggatgagagtggagaagaagaagaagaagatgatgaacagggtgcaacatgtggtgcttgcggtgataattatggcactgatgaattctggatctgttgtgatatgtgtgaaagatggttccatggtaaatgtgttaaaattactcctgctaaggctgagcacatcaagcaatacaagtgccctagctgcagtaacaagagggttagagtttga

SEQ ID NO: 370 - protein, 252 aa, Glycine max
MEGVPHPIPRTVEEVFTDFKGRRAGLIKALTTDVEKFYQQCDPEKENLCLYGFPNETWEVNLPVEEVPPELPEPALGINFARDGMQEKDWLSLVAVHSDSWLLAVAFYFGARFGFGKNERKRLFQMINDLPTIFELVTGSAKQSKDQPAAHNNGSKCKSSGKSHQSESQAKGMKMSAPPKEEDESGEEEEEDDEQGATCGACGDNYGTDEFWICCDMCERWFHGKCVKITPAKAEHIKQYKCPSCSNKRVRV

SEQ ID NO: 371 - DNA, 747 bp, Glycine max
atggacagtggaggacactacaacccccgcaccgtcgaagaggttttccgggacttcaagggccgccgggctggcatgatcaaagccctcaccactgatgttgaggaattttaccagcagtgtgatcctgaaaaggagaatttatgtctgtatggattccccactgaacaatgggaagtaaatttgcctgctgaagaagttcccccagaacttcccgagccagcactgggcataaattttgctagggatgggatgcaagaaaaggactggctatctttagttgctgtacacagtgatgcatggctacaatcagtggctttctactttggggcaagatttggttttgataaagctgacagaaagcgcctgttcactatgattaatgatttgcctacaatatttgaggttgtaactggatctgcaaagaaacagacaaaggagaagtcatcagagaacaatggcaacaaatcaaagtccagttcaaaagggcgaggatctgaacccccaaagtattcaaagcaagtgaaggatgaggaggagggattggacgaagaagacgatgacgagcatggggagaccttgtgtggagcatgtggggagaactatgcatccgatgagttctggatttgttgcgacatacgtgagaagtggtttcatggcaagtgtgtgaagatcactcctgcccgggctgagcacatcaaacactacaagtgcccctcatgcagcaataagagaccaaggccttga

SEQ ID NO: 372 - protein, 248 aa, Glycine max
MDSGGHYNPRTVEEVFRDFKGRRAGMIKALTTDVEEFYQQCDPEKENLCLYGFPTEQWEVNLPAEEVPPELPEPALGINFARDGMQEKDWLSLVAVHSDAWLQSVAFYFGARFGFDKADRKRLFTMINDLPTIFEVVTGSAKKQTKEKSSENNGNKSKSSSKGRGSEPPKYSKQVKDEEEGLDEEDDDEHGETLCGACGENYASDEFWICCDIREKWFHGKCVKITPARAEHIKHYKCPSCSNKRPRP

SEQ ID NO: 373 - DNA, 816 bp, Hordeum vulgare
atggacgcgcagtacaaccccaggacggtggaggaggtcttccgggactacaagggccgccgcaacggcctcgcccgcgcgctcaccaccgatgtggagaatttcttccggcaatgcgacccggaaaaagaaaatttgtgcctttatgggtttcccaatgagaattgggaagtaaatttacctgctgaagaagtgccacctgagctcccagagccagcattgggcatcaactttgcacgagatggaatgcaggaaaaagattggctgtccatggttgcagtacacagcgatgcatggttactatctgttgcattctactttggtgctcgattcggtttcgacaaaagtgacaggaagcgcctgtttggtatgattaatgagcttcccacggtttttgatgttgttagtgggaagagtaaaaccaaggccccgagcaatagtaaccacagcaatagcaaacccaagtccaacaataaaatgaaaacctcggagcctcgggcgaagcagcccaagccccagctgaaggaggaagaccgcgaggatgacaccctggatgccggcgatgatggcggagccgccgggggtggtggtggggaagagcacggggagacgctgtgcggcgcctgtggggacaactacgggcaggacgagttctggatcggctgcgacatgtgcgagaagtggttccacggcaagtgtgtcaagatcacgccggccaaggcggagcacatcaagcagtacaagtgcccctcgtgcatgggcgtcaatggcggcagcggcagcggcaacaacaagcgggcgcgcccgtcctcctaa

SEQ ID NO: 374 - protein, 271 aa, Hordeum vulgare
MDAQYNPRTVEEVFRDYKGRRNGLARALTTDVENFFRQCDPEKENLCLYGFPNENWEVNLPAEEVPPELPEPALGINFARDGMQEKDWLSMVAVHSDAWLLSVAFYFGARFGFDKSDRKRLFGMINELPTVFDVVSGKSKTKAPSNSNHSNSKPKSNNKMKTSEPRAKQPKPQLKEEDREDDTLDAGDDGGAAGGGGGEEHGETLCGACGDNYGQDEFWIGCDMCEKWFHGKCVKITPAKAEHIKQYKCPSCMGVNGGSGSGNNKRARPSS

SEQ ID NO: 375 - DNA, 774 bp, Lycopersicon esculentum
atggacgccggtggaggaggagaacagtttgattcccgaactgtggaagatgtgtttggggatttcaagagacgacgaactgctttgattaaggctcttactgttgatgtggaagaattttatcagcagtgtgatcctgagaaggaaaacttgtgcttgtatggtctcccaaatgaacaatgggaggtcaatctgcctgctgaagaagtaccacctgaactccctgagcctgctcttggtattaactttgctagagatgggatggaagacaaggattggctatccttagttgctgtccatagtgattcctggctgctttctgtcgccttctattttggtgctagatttgggtttgataaagccagcaggaagaagcttttcaacatgataaatgaactgcctacaatatatgaagtagtgactggtgcctcaaagaaacaacagaaagaaaaatcttctggccatagtggcaagaaatccaagtcaaattccaaggcgagggcacaagactatcaggagaagttagcaaagttgcaggctaaagatgaagaggaggagggtttggatgagcaggaggacgaggatgagcatggcgagacactgtgtggtgcctgtggagaaaattatgcagcagatgaattttggatatgctgtgacatttgtgaaaagtggttccacggcaagtgtgtgaagatcacccctgccaaggctgagcatatcaagcaatacaagtgtccgtcttgtagccacaagagacctcgagctgacatataa

SEQ ID NO: 376 - protein, 257 aa, Lycopersicon esculentum
MDAGGGGEQFDSRTVEDVFGDFKRRRTALIKALTVDVEEFYQQCDPEKENLCLYGLPNEQWEVNLPAEEVPPELPEPALGINFARDGMEDKDWLSLVAVHSDSWLLSVAFYFGARFGFDKASRKKLFNMINELPTIYEVVTGASKKQQKEKSSGHSGKKSKSNSKARAQDYQEKLAKLQAKDEEEEGLDEQEDEDEHGETLCGACGENYAADEFWICCDICEKWFHGKCVKITPAKAEHIKQYKCPSCSHKRPRADI

SEQ ID NO: 377 - DNA, 750 bp, Lycopersicon esculentum
atggaaaattcggtacccaggactgtagaagaagtattcagcgatttcaaaagtcgtagagctgctttgattaaagcacttaccacagatgttgagaagttttatcagcagtgtgatcctgaaaaggagaacttgtgtctctatgggcttcctaatgaaacatgggaagtaaacctcccggtggaagaggtgcctccagaacttcctgaaccagcattgggcataaattttgcacgtgatggaatgcaagaaaaagactggttatcacttgttgctgttcacagtgattcgtggctgctttctgttgcattttactttggcgcaaggtttgggttcggcaagagtgataggaagaggcttttccaaatgataaatgatctcccaacagtgtttgaagttgttactggagctgctaaacaaacacgtgatgctcctcacaacaatagcaacaaaagcaaatcaagtggaaagcctcggcagccagagtcccaactcaaggcagtaaaggtgtctccacctaaaatggagaacgacagtggtgaggaggaagaagaagaagaagaggatgaacaaggcgcaactctgtgtggagcttgtggtgataattatgcgactgatgaattctggatttgctgtgatatttgcgagagatggttccatggaaaatgtgtgaagattactccagctaaagctgagcatatcaaacagtacaagtgtcctagttgcagtagcaagagagctaaagtctaa

SEQ ID NO: 378 - protein, 249 aa, Lycopersicon esculentum
MENSVPRTVEEVFSDFKSRRAALIKALTTDVEKFYQQCDPEKENLCLYGLPNETWEVNLPVEEVPPELPEPALGINFARDGMQEKDWLSLVAVHSDSWLLSVAFYFGARFGFGKSDRKRLFQMINDLPTVFEVVTGAAKQTRDAPHNNSNKSKSSGKPRQPESQLKAVKVSPPKMENDSGEEEEEEEEDEQGATLCGACGDNYATDEFWICCDICERWFHGKCVKITPAKAEHIKQYKCPSCSSKRAKV

SEQ ID NO: 379 - DNA, 726 bp, Lycopersicon esculentum
atggcctcaatttcttcaagtcctcgaagtgtagaagagatcttcaaagattacagtgctcgtcgtgttgggatacttcgtgctttaactgatgatgtggatgaattttataatctctgtgatccagagaaggaaaatttgtgtctttatggacatccaaatgaaacttgggaagtcaaccttcctgcggaggaagttccacctgagctgccagagccagcacttgggataaattttgctagggatggaatgaatcgtagagattggctttccctggttgctgttcacagtgattgttggttgctttctgtggctttctattttggagctcgtcttaatcgaaatgaaaggaagcgtctattcagcttgatcaacgaggtgccaactgtctttgaagttgtgactgaaagaaaaccaataaaagataagcccagtgcagacagtggaagcagatcacgtggtagtagcataaagagatctagtgatggtcaggtgaaaagcaccccgaagctggaagatgaaagttatctggaggatgaagaagaacacggtgaaacactctgtggaagctgtggtgggaattacagtgctgatgaattttggattggctgcgacatctgtgagaagtggtaccatggcaagtgtgtgaagataacacctgctaaagctgagagtataaagcaatacaaatgcccgtcttgtaccttgaagcgaagcagacagtag

SEQ ID NO: 380 - protein, 241 aa, Lycopersicon esculentum
MASISSSPRSVEEIFKDYSARRVGILRALTDDVDEFYNLCDPEKENLCLYGHPNETWEVNLPAEEVPPELPEPALGINFARDGMNRRDWLSLVAVHSDCWLLSVAFYFGARLNRNERKRLFSLINEVPTVFEVVTERKPIKDKPSADSGSRSRGSSIKRSSDGQVKSTPKLEDESYLEDEEEHGETLCGSCGGNYSADEFWIGCDICEKWYHGKCVKITPAKAESIKQYKCPSCTLKRSRQ

SEQ ID NO: 381 - DNA, 771 bp, Medicago truncatula
atggacgcgcgcacacaatataatccacgcaccgttgaggaagttttcagagattttaagggtcgtcgtgctggtctcatcaaagctctcaccactgatgttgaagagttttatacccaatgtgatccggagaaggagaatctttgcttgtatggcttccctagtgagcagtgggaagtcaatttacctgctgaggaagttccgccagagcttcccgagcctgtacttggcattaactttgccagggatggcatgcaagagaaagactggctatctttggttgctgttcacagtgattcatggttaatcgccattgcgtactactttggtgccagatttggcttcgacaaatctgacaggaagcgcctgttcaacatgatcaatgatctgccatcaatatatgaagttgttactggtgctgcaaagaaacaagttaaggagaagtcttcagtttcaaaccacagtggcagcaaatccaagtccagctcgaaagcgcgggctccagaacctcaggtcaagcagacaaagccattggagttacctaaagatgatgaggtggaggaactggacgaggaagatgaagatgaacatggagagaccttatgtggtgcatgcggtgagcattatggcactgatgaattctggatttgctgtgacatctgcgagaagtggttccatgggaaatgtgtgaagatcacccctgctagggctgagcatatcaagcagtacaagtgtccatcatgcagtaacaataagagagctcgcccttga

SEQ ID NO: 382 - protein, 256 aa, Medicago truncatula
MDARTQYNPRTVEEVFRDFKGRRAGLIKALTTDVEEFYTQCDPEKENLCLYGFPSEQWEVNLPAEEVPPELPEPVLGINFARDGMQEKDWLSLVAVHSDSWLIAIAYYFGARFGFDKSDRKRLFNMINDLPSIYEVVTGAAKKQVKEKSSVSNHSGSKSKSSSKARAPEPQVKQTKPLELPKDDEVEELDEEDEDEHGETLCGACGEHYGTDEFWICCDICEKWFHGKCVKITPARAEHIKQYKCPSCSNNKRARP

SEQ ID NO: 383 - DNA, 753 bp, Medicago truncatula
atggaaggtcgaagtcgcaccgttgagcaaatttttgatgatttcaagagccgaagaactggaatcatcaaagccctaaccgtcgatgttgaagatttctaccgacaatgtgatcctgaaaaggagaatttgtgcttgtatggattgcttaatgagaattgggaagtgaatttacctgttgaagaagttcctccagagattcctgaacctgtgctgggtatcaactttgccagggatggaatgcaagagaaagactggttagccttagttgctgttcacagtgatacatggttactttcccttgcattctactttggagccagatttggatttgataaagctgacaggaaacgtctattcaatttgatcaatgaactgccaacagtatttgaagttgttactggtgctgcaaagaaacaagtcaaagagaagtcttcagtctcaaacaacagtggcagcaaatctaagtccagttctaaagcgcgagctcctgaggctcagagcagacaaccaaaagcggcattactgccaaaagatgaggaggaggaactggaagagcaggatgatgatgaacagggagaagccacttgcggggcttgtggtgatagtaatggagctgatgagttctggatttgctgcgacatctgcgagaagtggttccatggaaaatgtgtgaagatcactcctgctcgtgccgagcatatcaagcaatacaagtgcccatcatgcagcagtaacaagagagctcgctag

SEQ ID NO: 384 - protein, 250 aa, Medicago truncatula
MEGRSRTVEQIFDDFKSRRTGIIKALTVDVEDFYRQCDPEKENLCLYGLLNENWEVNLPVEEVPPEIPEPVLGINFARDGMQEKDWLALVAVHSDTWLLSLAFYFGARFGFDKADRKRLFNLINELPTVFEVVTGAAKKQVKEKSSVSNNSGSKSKSSSKARAPEAQSRQPKAALLPKDEEEELEEQDDDEQGEATCGACGDSNGADEFWICCDICEKWFHGKCVKITPARAEHIKQYKCPSCSSNKRAR

SEQ ID NO: 385 - DNA, 723 bp, Medicago truncatula
atggaaatggcgtcaagtcctcgcaccgttgaagagatcttcaaagatttcagttctcgtagagatggtatcgttcgtgctttaactcaagatgttgatgaattttatgcactctgtgatccagataaggacaatttgtgtctctatggacatacaaatgaatcatgggaagtgactcttcctgctgaggaagttccacctgagcttccagagccagcccttggaatcaactttgcaagggatggcatgaaccgtagggactggctttctctagttgctgtgcacagtgattcatggttgctttctgtggctttttatcttggagctcgtcttaaccgcaacgaaaggaaacgtttatttagcttgatcaatgagcttccaactgtgtttgaagttgtaactgacaggaagccaataaaggacaagcccactgtagatagtggaagcaaatctcggggaagcaccaagagatcaagtgatggacaagttaaaagcaacccaaagttggtcgatgatcaaggttatgaggaggaggaagacgagcatagtgaaaccctttgtgggagctgcggtggaaactacaacgcggatgaattttggattggctgtgatatttgtgagaggtggtaccatggaaaatgtgtgaagattactcctgctaaagctgagagcataaagcaatacaagtgcccatcatgcagcatcaagaggggcaggccctaa

SEQ ID NO: 386 - protein, 240 aa, Medicago truncatula
MEMASSPRTVEEIFKDFSSRRDGIVRALTQDVDEFYALCDPDKDNLCLYGHTNESWEVTLPAEEVPPELPEPALGINFARDGMNRRDWLSLVAVHSDSWLLSVAFYLGARLNRNERKRLFSLINELPTVFEVVTDRKPIKDKPTVDSGSKSRGSTKRSSDGQVKSNPKLVDDQGYEEEEDEHSETLCGSCGGNYNADEFWIGCDICERWYHGKCVKITPAKAESIKQYKCPSCSIKRGRP

SEQ ID NO: 387 - DNA, 795 bp, Medicago truncatula
atggcacagcacccggtacctcgaactgttgaagaagtttttagcgattacaaaggcagacgcgccggtttgatcaaagctctcactactgacgttgaaaagttttaccagctctgcgatcccgaaaaggagaatttgtgcctctatgggtttccaaatgaaacatgggaagtgaacttgcctgtcgaggaagtgcctcctgaacttcccgagccagcattgggtataaactttgctcgggatggaatgcaggagaaggactggttatcactggttgcagttcacagtgactcatggctgctcgctgttgctttctattttggtgcccgctttggatttggtaagaatgataggaaaaggctttttcagatgataaatgatctgccaactgtctttgagcttgcaacaggaactgctaagcaatcaaaggatcaactgactgctcacaacaatggtagcaatagcaagtacaaatcaagtggaaagtcccgccagtctgaatctcagaccaagggtgtgaagatgtctgcaccagtcaaagaagaggttgacagtggagaagaagaggaagatgatgatgaacaaggtgcaacctgtggtgcttgtggtgataattatggcaccgatgaattctggatctgttgtgatatgtgcgagaaatggttccatggtaaatgtgttaaaattactcctgccaaggctgaacacatcaagcaatacaagtgccctggctgcagtatcaaagccaagaattggatagctctgaacgtttggaccattagcgggcaagattag

SEQ ID NO: 388 - protein, 264 aa, Medicago truncatula
MAQHPVPRTVEEVFSDYKGRRAGLIKALTTDVEKFYQLCDPEKENLCLYGFPNETWEVNLPVEEVPPELPEPALGINFARDGMQEKDWLSLVAVHSDSWLLAVAFYFGARFGFGKNDRKRLFQMINDLPTVFELATGTAKQSKDQLTAHNNGSNSKYKSSGKSRQSESQTKGVKMSAPVKEEVDSGEEEEDDDEQGATCGACGDNYGTDEFWICCDMCEKWFHGKCVKITPAKAEHIKQYKCPGCSIKAKNWIALNVWTISGQD

SEQ ID NO: 389 - DNA, 762 bp, Medicago truncatula
atggaacttgctggtgatggaactccgtttgacccacgtaccgttgaagctgttttccgtgacttcaagggccgtagagctggcttgatcaaagctctcaccactgatgttgaagatttttaccagcagtgtgacccagaaaaggagaatctttctctgtatggatatcctggtgaattgtgggaagttactttacctgctgaagaagttcctcctgaacttccagaacctgcactgggcatcaattttgctagggatgggatgcaagaaaaggactggctatctttagttgcagttcacagtgatacatggcttctctctgtggctttctactttggcgcaagatttggctttgataaagccgacaggaaacgccttttcactctgattaatgatctgccaacaatatttgaggttgtgaccggatctgctaagaaacaaaccaaggaaaagccatctgtctcaagtcacaacagcatcaagtcaaagtcgggctcaaaagcgcgtggatctgaactggcaaagtattcaaagccgccagcaaaagaagatgatgaaggagtggacgacgaagaggaggatcaaggggaatgcgctgcatgcggtgaaagctacgtatctgcatcagatgagttctggatctgctgtgacatatgtgagaagtggtatcatggaaaatgtgtgaagatcactcctgcccgggctgagcacatcaagcagtacaagtgtcctgcttgcaacaataagagagtccggccttga

SEQ ID NO: 390 - protein, 253 aa, Medicago truncatula
MELAGDGTPFDPRTVEAVFRDFKGRRAGLIKALTTDVEDFYQQCDPEKENLSLYGYPGELWEVTLPAEEVPPELPEPALGINFARDGMQEKDWLSLVAVHSDTWLLSVAFYFGARFGFDKADRKRLFTLINDLPTIFEVVTGSAKKQTKEKPSVSSHNSIKSKSGSKARGSELAKYSKPPAKEDDEGVDDEEEDQGECAACGESYVSASDEFWICCDICEKWYHGKCVKITPARAEHIKQYKCPACNNKRVRP

SEQ ID NO: 391 - DNA, 819 bp, Oryza sativa
atggaaggaggcggaggcggaggcggaggcggtggcggaggtggaggtggaggaggcggaggcggggcaccgtacgccacgcgcacggcggaggaggtcttccgcgacctccggggccgccgcgccggcatgatcaaggccctcaccaccgatgtggagaagttttacaagctctgcgaccctgaaaaggagaacttgtgcctttatggatatcctaatgaaacatgggaggtgaccttgccagctgaggaagtgcccccagagatccctgaaccagcattgggaatcaacttcgctagggatggcatgaatgagaaagactggttggcgttagtcgcagttcacagtgattcctggttactgtctgttgcattctactttggagcccgatttggttttgacagagaagcaaggaggcgactctttaatatgataaacaatttgccaacaatatttgaggtagtgacaggagccgctaagaagcaggcgaaagaaaagactcccaacagtagtagcaagagcaacaagcctagttcgaaagtgcagtcaaaagctgagtctcgttcgaaatctaagctgtcagcccccaaggatgaagagggaagtggtgatgatgagggagaggaagaggaggatgaccatgacaacactttgtgtgggacctgtggaaccaacgatggcaaggacgagttctggatctgttgcgataactgcgagaagtggtatcatgggaagtgcgtcaagatcacacccgctcgtgccgagcatatcaagcagtacaagtgcccggactgcaccaacaagagggcccgggcatga

SEQ ID NO: 392 - protein, 272 aa, Oryza sativa
MEGGGGGGGGGGGGGGGGGGGGAPYATRTAEEVFRDLRGRRAGMIKALTTDVEKFYKLCDPEKENLCLYGYPNETWEVTLPAEEVPPEIPEPALGINFARDGMNEKDWLALVAVHSDSWLLSVAFYFGARFGFDREARRRLFNMINNLPTIFEVVTGAAKKQAKEKTPNSSSKSNKPSSKVQSKAESRSKSKLSAPKDEEGSGDDEGEEEEDDHDNTLCGTCGTNDGKDEFWICCDNCEKWYHGKCVKITPARAEHIKQYKCPDCTNKRARA

SEQ ID NO: 393 - DNA, 804 bp, Oryza sativa
atggacgagggaggcggcgctggtgctgcggctgccgccgccgggaacgcggcgggggcggcggtgcaccacaacgcgcggtccgcggaggacgtcttccgcgacttccgcgcgcgccgcgcgggcatcgtcaaggcgctcaccaccgatgtggagaagttctaccggcagtgcgaccccgagaaagagaacctgtgcctttatggattgcccaatgagacctgggacgtgacccttccagctgaggaagtacctcctgaacttccagaaccagcactgggcataaactttgctcgtgatggaatgatcgaaaaagattggttgtcgctggttgcagttcatagcgatgcatggctactgtctgtagcattttactttggggctcgctttggatttgataaggaagccaggagacggctcttcaccatgattaatggtcttcccactgtatatgaagttgtgacgggaattgccaagaagcaaacaaaagtctccaacggcagcagcaaaagcaacaagtccaaccctaaaccatcgaagcaatccaattctaacagcaagcctgcaaagccacctcagccaaaagatgaggaagacagcggcccggaaggcacagaggatgaggaccaggcttacatgtgtggcgcttgcggagagacttacgcgaacggtgagttctggatctgctgcgacgtctgcgagaagtggttccatggcaagtgcgttcggatcacccctgcgaaggcagagcacatcaagcagtacaagtgccctggctgcagcagcaagaggagccgagaatga

SEQ ID NO: 394 - protein, 267 aa, Oryza sativa
MDEGGGAGAAAAAAGNAAGAAVHHNARSAEDVFRDFRARRAGIVKALTTDVEKFYRQCDPEKENLCLYGLPNETWDVTLPAEEVPPELPEPALGINFARDGMIEKDWLSLVAVHSDAWLLSVAFYFGARFGFDKEARRRLFTMINGLPTVYEVVTGIAKKQTKVSNGSSKSNKSNPKPSKQSNSNSKPAKPPQPKDEEDSGPEGTEDEDQAYMCGACGETYANGEFWICCDVCEKWFHGKCVRITPAKAEHIKQYKCPGCSSKRSRE

SEQ ID NO: 395 - DNA, 744 bp, Oryza sativa
atggaaatggcccccgcggcgcaggtggcgtcgaacccgcggacggtggaggacatcttcaaggattactcggcgcggcgcggcgcgctcgtccgcgcgctcacctcagatgtggacgagttcttcgggctctgcgacccagataaggagaatttgtgcctgtacggcctcgccaacgggagctgggaggtggcgctgccggcggaggaggtgccgccggagctgcccgagccggcgctcggcatcaacttcgcccgcgacgggatgaaccgccgggactggctctccctcgtcgccgtccactccgactcgtggctcgtctccgtcgccttcttcttcgccgcgcggctcaacggaaacgaacggaagcggctcttcaacatgatcaatgatctacctactgtatatgaagcattggttgacaggaagcacgtcagggataggtctggtgtcgatagcagcggaaaatccaaacattcaacaaagagaacaggcgaagggcaggtaaagcgctccagggttgtcgcagaggagtacgaggacgacgacgaagaacacaacgagacattctgcggaacttgcggtggcctctacaacgcgaacgagttctggatcgggtgcgacatctgtgagcggtggttccacggcaaatgcgtcaggataaccccggctaaggcggagcacatcaagcactacaagtgccctgactgcagcagcagctcctccaagaaaaccaggctatag

SEQ ID NO: 396 - protein, 247 aa, Oryza sativa
MEMAPAAQVASNPRTVEDIFKDYSARRGALVRALTSDVDEFFGLCDPDKENLCLYGLANGSWEVALPAEEVPPELPEPALGINFARDGMNRRDWLSLVAVHSDSWLVSVAFFFAARLNGNERKRLFNMINDLPTVYEALVDRKHVRDRSGVDSSGKSKHSTKRTGEGQVKRSRVVAEEYEDDDEEHNETFCGTCGGLYNANEFWIGCDICERWFHGKCVRITPAKAEHIKHYKCPDCSSSSSKKTRL

SEQ ID NO: 397 - DNA, 771 bp, Oryza sativa
atggacggcggctacggctcggtcacaatcgtccacgacgcgcgctcccccgaggacgtcttccaggacttctgcggccgccgctccggcatcgtcaaggccctcaccatcgaggtggagaagttctacaagcagtgcgaccctgagaaggagaacttgtgcctctatggactgcctaatggaacctgggcagtgactctaccagctgatgaagttcctcctgaactaccagagccagccctcgggataaacttcgctcgtgatggaatgcaggaaaaagattggctgtccctgatagctgtccatagtgattcatggttactgtctgtggcattttactttggggctcgttttggatttgataaaaaggccagggaacggctcttcatgatgaccagtagtctccccactgtctttgaagttgtgtcaggaggtgtgaatacacaatcaaaaaccgccaacggcagtagcaaaaacaagtcaggctctaagccaccaaagcggcccaattctgacagcaagccacagaagcaggtccaggcaaagtatgaggaagagaacggcggcagaggaaatggaggtgatgaagatcaagctgaaaccatttgtggcgcctgtggtgaggcctacgcaaacggcgagttctggatttgctgtgacatttgtgagacctggttccatggcaaatgtgtccgaatcacccctgccaaggcggagcacatcaagcattacaagtgtcctggctgcagcaacaagaggaccagagaatga

SEQ ID NO: 398 - protein, 256 aa, Oryza sativa
MDGGYGSVTIVHDARSPEDVFQDFCGRRSGIVKALTIEVEKFYKQCDPEKENLCLYGLPNGTWAVTLPADEVPPELPEPALGINFARDGMQEKDWLSLIAVHSDSWLLSVAFYFGARFGFDKKARERLFMMTSSLPTVFEVVSGGVNTQSKTANGSSKNKSGSKPPKRPNSDSKPQKQVQAKYEEENGGRGNGGDEDQAETICGACGEAYANGEFWICCDICETWFHGKCVRITPAKAEHIKHYKCPGCSNKRTRE

SEQ ID NO: 399 - DNA, 777 bp, Oryza sativa
atggacgcatcctaccgccgcgacggccgcggaggcggcggcggcgggggcggcggcggttccgcccctcgctccgtcgaggacatcttcaaggacttccgcgcccgccgcaccgccatcctccgcgccctcacccacgacgtcgaggatttctacgcgcagtgcgatccagagaaggagaatctgtgcctgtacgggtacgcgaacgaggcgtggcaggtggcgctgccggcggaggaggtgcccaccgagctgccggagccggcgctcgggatcaacttcgcccgcgacgggatgaaccgccgcgactggctcgcgctcgtcgccgtccactccgactcgtggctcgtctccgtcgccttctactacgccgcgcgcctcaaccgcaacgaccggaagcgtttgtttggcatgatgaatgatttgccaactgtttacgaagtcgtatctggttcaagacaatctaaggagagggacagatccggcatggacaacagcagcagaaataaaatttcatcgaagcataccagcgacgtggcgcgtgtcgaaaataatatcaaggaggaagatgaaggctacgacgaggacgatggcgaccacagtgagaccctatgcgggacttgcggtgggatatacagcgccgacgagttctggatcggctgcgacgtgtgcgagaggtggtaccacggcaagtgcgtcaagatcactccggcgaaggcggagagcataaagcagtacaagtgcccgagctgcagctccaagagacctagacagtag

SEQ ID NO: 400 - protein, 258 aa, Oryza sativa
MDASYRRDGRGGGGGGGGGGSAPRSVEDIFKDFRARRTAILRALTHDVEDFYAQCDPEKENLCLYGYANEAWQVALPAEEVPTELPEPALGINFARDGMNRRDWLALVAVHSDSWLVSVAFYYAARLNRNDRKRLFGMMNDLPTVYEVVSGSRQSKERDRSGMDNSSRNKISSKHTSDVARVENNIKEEDEGYDEDDGDHSETLCGTCGGIYSADEFWIGCDVCERWYHGKCVKITPAKAESIKQYKCPSCSSKRPRQ

SEQ ID NO: 401 - DNA, 777 bp, Oryza sativa
atggacggaggctccggggggccgtacacctcccgcacggccgaggaggtcttccgcgacttccgcggccgccgcgccggcatgatcaaggccctcaccaccgatgtggagaagttctaccagctctgcgacccagaaaaggagaacttgtgcctttatgggtaccctaatgaaacatgggaagttaccttgcctgctgaggaagttcctccggagatccctgaaccagctttaggaatcaattttgctagggacggcatgaatgagaaagactggttggcactagttgctgtccacagtgattcatggctactggctgttgcgttttatttcgcagcacgatttgggttcgacaaagaggccaggaggcggctcttcaacatgataaataacttacctacaatatttgaagttgtgactggcgctgccaagaaacagaccaaggagaaggcgcccaacagtaccaacaagcccaacaagcccagctcaaaaatgcaaccaagaccagagtctcattcaaaggctccaaaaccacctgcaccccccaaggatgatgatgagagcggcgatgagtatgcagacgaggaggaggaggagcgcgacaacaccctgtgcggatcttgtggaacaaatgatggcaaagatgagttttggatctgttgtgatagttgcgagcggtggtaccatggaaagtgcgtgaagatcacacctgctcgagccgagcatatcaaacactacaagtgcccagattgcggcaacaagagggcaagggcatag

SEQ ID NO: 402 - protein, 258 aa, Oryza sativa
MDGGSGGPYTSRTAEEVFRDFRGRRAGMIKALTTDVEKFYQLCDPEKENLCLYGYPNETWEVTLPAEEVPPEIPEPALGINFARDGMNEKDWLALVAVHSDSWLLAVAFYFAARFGFDKEARRRLFNMINNLPTIFEVVTGAAKKQTKEKAPNSTNKPNKPSSKMQPRPESHSKAPKPPAPPKDDDESGDEYADEEEEERDNTLCGSCGTNDGKDEFWICCDSCERWYHGKCVKITPARAEHIKHYKCPDCGNKRARA

SEQ ID NO: 403 - DNA, 735 bp, Oryza sativa
atggagatggccgcccccgtctcccccgcgccgcgcaccgtcgaggacatcttcaaggacttctccggccgccgcgccggcctcgtccgcgccctcaccgtcgatgtggatgagttctacggattctgcgacccagagaaggagaatttgtgcctgtacgggcacccgaacgggcggtgggaggtggcgctgccggcggaggaggtgccgccggagctgccggagccggcgctcgggatcaacttcgccagggacgggatgcaccgccgcgactggctctcgctcgtcgccgtccactccgactcgtggctgctctccgtcgccttcttcttcggcgcgcgcctcaacggcaacgagaggaagcgcttattcagcttgatcaatgaccatccaaccgtgcttgaagcactgtctgataggaagcatggaagggataataaatctggtgccgacaatggcagcaaatccaggcactcaggaaagcgagcaaatgacgtgcagacaaaaacctcgaggccagcagttgttgacgatgggtacgatgaagaagaacacagtgaaaccctatgtggaacctgcggtggccgctacaacgccaacgagttttggattgggtgcgacatttgcgagcggtggttccacggcaaatgcgttaggataacaccagcgaaagcggaacacataaagcactacaagtgccctgattgcagcagctccaagaagagtaggcaataa

SEQ ID NO: 404 - protein, 244 aa, Oryza sativa
MEMAAPVSPAPRTVEDIFKDFSGRRAGLVRALTVDVDEFYGFCDPEKENLCLYGHPNGRWEVALPAEEVPPELPEPALGINFARDGMHRRDWLSLVAVHSDSWLLSVAFFFGARLNGNERKRLFSLINDHPTVLEALSDRKHGRDNKSGADNGSKSRHSGKRANDVQTKTSRPAVVDDGYDEEEHSETLCGTCGGRYNANEFWIGCDICERWFHGKCVRITPAKAEHIKHYKCPDCSSSKKSRQ

SEQ ID NO: 405 - DNA, 837 bp, Oryza sativa
atggacgcgcagtacaacccgcgaacggtggaggaggtcttccgcgacttcaagggccgccgcgccggcctcgtccgcgcgctcaccgcagatgtggaggatttcttccggcaatgcgacccggaaaaggaaaacttgtgcctttatgggtttcccaatgagcattgggaagtaaatttgcccgcagaagaggtgccacctgagctcccagagccagcattgggcattaactttgcacgagatgggatgcaggaaaaagattggctgtccatggttgcagtgcacagtgatgcatggttactttctgttgcattttactttggtgctcggttcggatttgataaaaatgacaggaagcgcctgtttggtatgattaatgatcttcccacgatttttgaagttgttagtgggaagagtaaagccaagccaccgagtgctaataaccacagcaatagtaaatcaaaatccagcaataaaacgaagtcttctgagcctcgggcgaagcagccaaagccgcagccccagcccccagtgaagaacgaaggccgcgaggaggaaggcggcccggacgacgaggaaggcggcggtggcggcggaggaggcggtagggaggaggagcacggggagacgctgtgcggcgcgtgcggggagagctacggcgccgacgagttctggatctgctgcgacatctgcgagaagtggttccacggcaagtgcgtcaagatcaccccggccaaggcggagcacatcaagcagtacaagtgcccctcctgcagcggcggcaacggcggtggcggcggcgtcagcggcaacggcaagcgtgcgcgcccgtcctaa

SEQ ID NO: 406 - protein, 278 aa, Oryza sativa
MDAQYNPRTVEEVFRDFKGRRAGLVRALTADVEDFFRQCDPEKENLCLYGFPNEHWEVNLPAEEVPPELPEPALGINFARDGMQEKDWLSMVAVHSDAWLLSVAFYFGARFGFDKNDRKRLFGMINDLPTIFEVVSGKSKAKPPSANNHSNSKSKSSNKTKSSEPRAKQPKPQPQPPVKNEGREEEGGPDDEEGGGGGGGGGREEEHGETLCGACGESYGADEFWICCDICEKWFHGKCVKITPAKAEHIKQYKCPSCSGGNGGGGGVSGNGKRARPS

SEQ ID NO: 407 - DNA, 765 bp, Oryza sativa
atggacggaggcggggcgcaccgcacgccggaggacgtgttccgggacttccgcgcgcggcgggccgggatgatcaaggcgctgaccacagatgtggagaagttctaccagcagtgcgacccagagaaagagaatttgtgtttatatggtcttcccaatgagacatgggaagtgaacttgcctgctgaggaggttcctccagagcttccagaaccagctctgggaattaattttgctcgggatgggatggatgagaaagattggctgtcacttgttgcggttcatagtgatacctggctgctagcagtagccttttactttggagcaagattcgggtttgacaaagaatccaggaaacggctttttagcatgattaacaaccttccaaccatatatgaggttgtcactgggactgcaaagaagcagagcaaagaaaaaacccccaagaccagtggcaagagcaataaatccggcacgaagccatcgcgccagccggaacccaactctaggggtccaaagatgccacctccgaaggatgaggatgatagcggaggtgaggaagaggaggaagaagaagatcacgaaaacacattatgtggtgcatgtggtgacaactatggacaggatgagttctggatctgctgcgatgcttgtgagacatggttccacggtaagtgtgtcaagataacccctgccaaggctgagcacatcaagcactacaagtgcccgaactgcagcagtagtagcaagagagccagagcttga

SEQ ID NO: 408 - protein, 254 aa, Oryza sativa
MDGGGAHRTPEDVFRDFRARRAGMIKALTTDVEKFYQQCDPEKENLCLYGLPNETWEVNLPAEEVPPELPEPALGINFARDGMDEKDWLSLVAVHSDTWLLAVAFYFGARFGFDKESRKRLFSMINNLPTIYEVVTGTAKKQSKEKTPKTSGKSNKSGTKPSRQPEPNSRGPKMPPPKDEDDSGGEEEEEEEDHENTLCGACGDNYGQDEFWICCDACETWFHGKCVKITPAKAEHIKHYKCPNCSSSSKRARA

SEQ ID NO: 409 - DNA, 714 bp, Rosa hybrid
  misc_feature (696)..(696): n is a, c, g, or t
atgccatcttcgagccctcgcagcgtcgaagagatcttcagagattacagcgctcgccgctctggcatcgttcgcgcccttaccaacgatgtggatgaattctatgcgctttgcgatccagagaaggagaatttgtgcttgtatggacacccggatgagtcgtgggaggtgaatctgccggcggaggaagtgccgccagagcttccggagcctgcgttggggattaattttgcgagagatgggatgaaccgccaagattggctgtctttgattgcagtgcatagtgattcttggttgttgtctgtgtctttctactttggtgctcgccttaatcggaatgagaggaagcgtctatttagcttgacaaatgatctgccaactgtctttgaagtcgtaactggaaggaagcccgctagagacaaacccagtgcagatagtggaagcaaatccaggaacaatgcaaagagatcaactgatggacctatgaggaccaatagtacgttgctcgatgaaaattacgtggaggatgaagatgagcatagtgaaactctatgtggaagctgtgggggaaattacagtgctaatgagttttggattggctgtgacatctgcgagagatggtaccatgggaagtgtgtgaagataacaccatccaaggccgagtatatccagcagtacaaatgcccttcttgctcnaagaagggaaggcagtga

SEQ ID NO: 410 - protein, 237 aa, Rosa hybrid
MPSSSPRSVEEIFRDYSARRSGIVRALTNDVDEFYALCDPEKENLCLYGHPDESWEVNLPAEEVPPELPEPALGINFARDGMNRQDWLSLIAVHSDSWLLSVSFYFGARLNRNERKRLFSLTNDLPTVFEVVTGRKPARDKPSADSGSKSRNNAKRSTDGPMRTNSTLLDENYVEDEDEHSETLCGSCGGNYSANEFWIGCDICERWYHGKCVKITPSKAEYIQQYKCPSCSKKGRQ

SEQ ID NO: 411 - DNA, 765 bp, Picea sinensis
atggaaggcggtggtttcgctcggcacaccgtggaggacgttttcaaagacttcaaagcacgtcgagctggcttgatcaaagcccttactaccgatgtggaggagttttatcagcaatgtgatccagataaggacaatctatgtctttatggatttccaagtgaaacatgggaagttaatctacctgcagaagaggtgcctcctgaacttccagagccagctctgggaataaactttgcaagagatgggatgcaagaaaaggattggctatcgctggtcgctgtacacagtgattcctggctacttgcagtttctgtctattttggtgcacgatttgggtttgacaaaaatgaccgaaggcggctttttaacatgatgaatgaacttccaacaatatacgaggttgttactggaactgcaaagaagcaagtaaaagaaagatctacagttaccaacaacagcagtagcaaaaacaagttaggagggaaggtgcggtcatctgaatctcaaccaaaaatgtcaaagttaccgctatccaaggatgaggaagatatcttagacgaagaggatgatgaggaacatggagagaccctctgtggagcctgtggtggagtttattcctctcaaactgcagaattttggattgcatgtgatatgtgtgagaattggtttcatgggaaatgtgtgaagatcactcctgcaagagctgaacacattaaacagtacaaatgtccatcctgcagtaataaaagaatccgtgtttaa

SEQ ID NO: 412 - protein, 254 aa, Picea sinensis
MEGGGFARHTVEDVFKDFKARRAGLIKALTTDVEEFYQQCDPDKDNLCLYGFPSETWEVNLPAEEVPPELPEPALGINFARDGMQEKDWLSLVAVHSDSWLLAVSVYFGARFGFDKNDRRRLFNMMNELPTIYEVVTGTAKKQVKERSTVTNNSSSKNKLGGKVRSSESQPKMSKLPLSKDEEDILDEEDDEEHGETLCGACGGVYSSQTAEFWIACDMCENWFHGKCVKITPARAEHIKQYKCPSCSNKRIRV

SEQ ID NO: 413 - DNA, 765 bp, Picea sinensis
atggaaggcgtttcagggtcatacaatccgcgcacggtagaagaagtatttaaagacttcaagatgcgcagaaatggattgataaaagccctcacgacagacgtggaggagttttaccagcaatgcgacccggacaaggagaatttgtgtctctatggatttccaaatgaatcatgggaagttaatctccctgctgatgaggtgccaccagagcttcctgagcctgcactgggaatcaactttgcaagggatgggatgcaagaaaaggattggttatctttggttgctgttcacagcgatgcatggctactttcagttgccttttattttggtgcacgatttggttttgacagaaatgagaggaggcgtcttttccacatgattaatgagcttccaacaatatttgagtgtgttactgggattggaaaaaggccaacaaaggaaaaatcggctgttactaacaacagtggtagtaaaaacaagcaaagtggaaagatgagaccatctgaatctcagatgaaaatgtcaaagacaccactacctagggatgaggatgactcgttggatgaagaggatgaagatgagcacggagaaaccttgtgtggagcttgtggagaaaactatgcctctgatgagttttggatctgttgcgatatgtgtgagagatggttccatggtaaatgtgtgaagattactccagctagggctgaacatatcaagcagtacaaatgcccctcatgcaccaataaaaggccccggccctga

SEQ ID NO: 414 - protein, 254 aa, Picea sinensis
MEGVSGSYNPRTVEEVFKDFKMRRNGLIKALTTDVEEFYQQCDPDKENLCLYGFPNESWEVNLPADEVPPELPEPALGINFARDGMQEKDWLSLVAVHSDAWLLSVAFYFGARFGFDRNERRRLFHMINELPTIFECVTGIGKRPTKEKSAVTNNSGSKNKQSGKMRPSESQMKMSKTPLPRDEDDSLDEEDEDEHGETLCGACGENYASDEFWICCDMCERWFHGKCVKITPARAEHIKQYKCPSCTNKRPRP

SEQ ID NO: 415 - DNA, 744 bp, Picea sinensis
atggagaccgccgcctcaattccttcaaaccctcgcacggtggaagaggtgtttagagacttcagaggccgaagaaccgccatcgtccgtgctctcaccactgaggtcgacctttttttcgcgctttgcgatccagacaaagagaatttatgcctatatggatatgctagtcaatcatgggaagttaacttgcctgctgaagaagtgccaccggagctcccagaaccagctttaggtatcaattttgcaagagatggcatgcagcggaaagattggctttccttagttgctgtgcatagtgatgcttggttgctagctgttgctttctaccatggtgctcggtttaaccggaatgagaggaaacgtctttttagtatgataaacgatcttccaactgtgtttgaggtggttactgagaggaagcaagcaaaggagaagactaactctgataatagtggaagcaaatctaaaccatctggaaagcgaatgcgtgatggtcaaataaagaattctaaatcaacttcagtgaaagaggaggaagaaacatacgaggatgatgatgaagagcacagtgatacaatctgtggaatttgtgaggagacctattctactgatgaattttggatcgggtgtgattcttgtgaaaggtggtatcatggcaagtgtgtgaaaatttcagcgactaaagcgcaaagtatcaagcaatacaaatgccctttatgcactagcaagaaagttcgctag

SEQ ID NO: 416 - protein, 247 aa, Picea sinensis
METAASIPSNPRTVEEVFRDFRGRRTAIVRALTTEVDLFFALCDPDKENLCLYGYASQSWEVNLPAEEVPPELPEPALGINFARDGMQRKDWLSLVAVHSDAWLLAVAFYHGARFNRNERKRLFSMINDLPTVFEVVTERKQAKEKTNSDNSGSKSKPSGKRMRDGQIKNSKSTSVKEEEETYEDDDEEHSDTICGICEETYSTDEFWIGCDSCERWYHGKCVKISATKAQSIKQYKCPLCTSKKVR

SEQ ID NO: 417 - DNA, 789 bp, Picea sinensis
atggaaggagggtatatcaaaccaatggaaggagggtcggggccttacaatccgcgcacagtggaagaggtcttcaaggatttcaagggccgaagagccggaatgattaaggccctcaccaatgatgtggaagagttttaccagcaatgtgatccggagaaagagaacttgtgtctttatgggttgccaaatgagtcatgggaagttaatcttccggctgaagaggtacctccagagcttcctgagccagctctgggaattaactttgcaagggacggaatgcaagaaaaagattggctatctttagttgctgttcatagtgatgcgtggttgcttgctgtttcgttctactttggtgcaagatttgggttcgacaggaatgaaaggaaacgactttttatcatgatcaatgaacttccaactatttttgaggttgttactggagctgcaaaaaagcaatcaaaggaaaaatctactgtgaccaacaacagtagcagcaagaacaagtctggtataaagccacgagtatctgaatctcaaacaaagtcatcaaagttaccaccacctaaagatgaggatgatacgttggatgaagaggaagacgatgagcatggtgacacactttgtggagcttgtggtgaaaattatgcctctgatgagttttggatctgttgtgatatgtgtgagaaatggttccatggcaaatgtgttaagattactcctgcaagagctgaacacattaagcattataaatgtccatcttgcagcaacaaaaggccccgagtttaa

SEQ ID NO: 418 - protein, 262 aa, Picea sinensis
MEGGYIKPMEGGSGPYNPRTVEEVFKDFKGRRAGMIKALTNDVEEFYQQCDPEKENLCLYGLPNESWEVNLPAEEVPPELPEPALGINFARDGMQEKDWLSLVAVHSDAWLLAVSFYFGARFGFDRNERKRLFIMINELPTIFEVVTGAAKKQSKEKSTVTNNSSSKNKSGIKPRVSESQTKSSKLPPPKDEDDTLDEEEDDEHGDTLCGACGENYASDEFWICCDMCEKWFHGKCVKITPARAEHIKHYKCPSCSNKRPRV

SEQ ID NO: 419 - DNA, 774 bp, Picea sinensis
atggagggtgctgctggacctcacaatggccgcagtgtcgaagaagttttcaaggatttcaagggccgtcgagctggaatgatcaaagccctcaccactgatgtggagttattttaccagcaatgcgatccagagaaagagaatttgtgtctgtatggccttccaatcgaaacatgggaagttaatttacctgctgaagaagtgccacctgaacttcccgagccagctctgggaattaactttgcaagggatggaatgcaagaaaaagattggctatctttggtagctgttcacagtgatgcatggttacttgcagtggcattctattttggtgcgcgatttggatttgagaaaaatgacaggaggcgtcttttcaacatgatcaatgagcttcctactatatttgaggtggtgacgggaactgtaaagaagcaaacaaaagagaaatcaagtgtgatcaatcacaatggcaataaaagcaaacctaatgcaaaattgcgtgtttctgaatcacagacaaaagtatcaaagttaccacctccacctaaggaagaggatgatacacttgatgaagaggatgaggaggaacatggcgatgcactctgcggagcctgtggtgaatattatgcttctgatgagttttggatctgttgtgacatgtgtgaggtatggttccatggtaaatgtgtgaagattacgccagcaagagcagagcatattaagcagtacaaatgcccgtcttgcagcagtagtaccaaacgagcccgagcttga

SEQ ID NO: 420 - protein, 257 aa, Picea sinensis
MEGAAGPHNGRSVEEVFKDFKGRRAGMIKALTTDVELFYQQCDPEKENLCLYGLPIETWEVNLPAEEVPPELPEPALGINFARDGMQEKDWLSLVAVHSDAWLLAVAFYFGARFGFEKNDRRRLFNMINELPTIFEVVTGTVKKQTKEKSSVINHNGNKSKPNAKLRVSESQTKVSKLPPPPKEEDDTLDEEDEEEHGDALCGACGEYYASDEFWICCDMCEVWFHGKCVKITPARAEHIKQYKCPSCSSSTKRARA

SEQ ID NO: 421 - DNA, 702 bp, Populus trichocarpa
atggcgtcccctcgcactgtagaagagatcttcaaagattacaacgcccgtcgctctgccctcgttcgcgctctcactattgaggctgatgaagtctaccttcaatgcgatccagaaaaagagaatttgtgtctgtatggacatccaaacgagtcctgggaagtgactctgccagcagaggaagttccgccagagctccctgagccggcgttgggcattaattttgccagagatggaatgacgcgtaaagactggctttctcttgttgctgtgcacagtgacagttggttgctttcagtgggattctactttggtgcacgacttaatcgcaacgaaaggaagcgactgtttagcatggtaaatgatctgcccaccctctttgaaattgtgaccgggaggaaaccagtagaagataagcctagtgctgacggtggtagcaaatccaggaataacacaaagagatcaactgatggacaggcaagaagcaattccaagttaagttacgtggaggatgaagatgagcatggggacaccctttgcgggagctgtggagggaactacaatgctgatgagttttggattggttgtgacatttgtgaacgatggtaccatggaaagtgtgtgaagataacaccagcaaaagctgaaagcatcaagcagtacaaatgcccttcttgcagcacaaagaaatctaggcactaa

SEQ ID NO: 422 - protein, 233 aa, Populus trichocarpa
MASPRTVEEIFKDYNARRSALVRALTIEADEVYLQCDPEKENLCLYGHPNESWEVTLPAEEVPPELPEPALGINFARDGMTRKDWLSLVAVHSDSWLLSVGFYFGARLNRNERKRLFSMVNDLPTLFEIVTGRKPVEDKPSADGGSKSRNNTKRSTDGQARSNSKLSYVEDEDEHGDTLCGSCGGNYNADEFWIGCDICERWYHGKCVKITPAKAESIKQYKCPSCSTKKSRH

SEQ ID NO: 423 - DNA, 717 bp, Populus trichocarpa
atggaaatgacttcaagcccacgaaccgtagaggagatcttcaaagatttcagtgctagaagagctgctgtcgtccgtgctttaacttatgatgtggatggtttttatggactctgtgatccagataaggagaatttgtgtctgtatggacatccaaatgaaacatgggaagtaaccctgccagcagaggaagttccaccagagcttcctgaacctgcccttggaattaattttgctagagatggaatgaacagaaaagactggctttcactggttgccgtgcatagtgattcatggttgctttctgtggctttctatcttggtgctcgtcttaataggaatgaaaggaaaaggctgttcagcctgatcaatgatctgcctactgtctttgaagttgtaacagaaaggaagcctgtgaaagaaaagcctagtgtagatagtggaagcaaatctcgaggcagcataaagagatcaagtgatggactaacgaaaagcaaccctaagcttacagaagatagttttgaggaggaagaagatgaacacactcaaactctatgtgggagctgtggtggaaattacaactccgatgaattctggatcggctgtgatgtctgcgagaggtggtaccatggaaagtgtgtgaagataactcctgctaaggctgagagtattaagcaatacaagtgtccatcttgtatgaagaggagccggccatag

SEQ ID NO: 424 - protein, 238 aa, Populus trichocarpa
MEMTSSPRTVEEIFKDFSARRAAVVRALTYDVDGFYGLCDPDKENLCLYGHPNETWEVTLPAEEVPPELPEPALGINFARDGMNRKDWLSLVAVHSDSWLLSVAFYLGARLNRNERKRLFSLINDLPTVFEVVTERKPVKEKPSVDSGSKSRGSIKRSSDGLTKSNPKLTEDSFEEEEDEHTQTLCGSCGGNYNSDEFWIGCDVCERWYHGKCVKITPAKAESIKQYKCPSCMKRSRP

SEQ ID NO: 425 - DNA, 714 bp, Populus trichocarpa
atggaaatggcttcaagcgcacgaactgtagaggagatcttcaaagatttcagtgctagaagagctgctgttgtgcgtgctttaactcatgatgtggatgctttttatggactctgtgatccagacaaggagaatttgtgtctgtacggacatccaagtgagacatgggaagtagccctgccagcagaagaagttccaccagagctccctgaacctgcccttggaattaattttgctagagatgggatgaacagaaaagactggctttctcttgttgctgtgcacagtgattcatggttgctttcggtggctttctatctcggtgctcgtcttaatcggaatgagaggaaacgactattcagcttgatcaatgatctgcctactgtctttgaagttgtaacagaaaggaagcctgtgaaagaaaagcctagtgtagatagtggaagcaaatctcgaggcagcataaagagatcaagtgatggacaaatgaaaagcaaccctaagcttatggaagatagttacgaggatgaagaagaccacactgaaacgctatgtgggagctgtggtggaaattacaatgctgacgaattctggattggctgcgatgtctgcgagaggtggtaccatggaaagtgcgtgaagataacacccgctaaggctgacagtattaagcaatacaagtgtccatcttgtatgaagaggagccggtcatag

SEQ ID NO: 426 - protein, 237 aa, Populus trichocarpa
MEMASSARTVEEIFKDFSARRAAVVRALTHDVDAFYGLCDPDKENLCLYGHPSETWEVALPAEEVPPELPEPALGINFARDGMNRKDWLSLVAVHSDSWLLSVAFYLGARLNRNERKRLFSLINDLPTVFEVVTERKPVKEKPSVDSGSKSRGSIKRSSDGQMKSNPKLMEDSYEDEEDHTETLCGSCGGNYNADEFWIGCDVCERWYHGKCVKITPAKADSIKQYKCPSCMKRSRS

SEQ ID NO: 427 - DNA, 714 bp, Populus trichocarpa
atggcttccatactcacaagccctcgcactgtagaagagatcttcaaagattacagcgctcgtcgctctgccctcgttcgtgctctcactatcgaagccgatgaagtttacattcaatgcgatccagaaaaagaaaatctgtgcttgtatggacatccaactgagtcctgggaggtgaccctgccagctgaggaagttcccccggagctccctgagcctgctttgggcattaattttgccagggatgggatgagtcgtaaagattggctctctcttgtggctgtccatagtgactgttggttgctttccatggcattctactttggtgcacgacttaatcgcaacgacaggaagcgattgtttagcatgataaatgatctgcccaccctctttgaaattgtaactgggaggaaaccagcagaagacaaacctagtgcagaaagcggcagcaaatccaggaataacacaaagagatcaatagatggacaggcgagaagtaattccaagttaagttatgtggaggatgaagacgagcatggagacaccatttgtgggagctgtgcagggaactacaatgccgatgagttttggattggttgtgacatctgtgaacgatggtaccatggaaaatgtgtgaagataacaccagcaaaagcagaaagtatcaagcagtacaaatgcccttcttgcagcacaaagaagtccaggcactaa

SEQ ID NO: 428 - protein, 237 aa, Populus trichocarpa
MASILTSPRTVEEIFKDYSARRSALVRALTIEADEVYIQCDPEKENLCLYGHPTESWEVTLPAEEVPPELPEPALGINFARDGMSRKDWLSLVAVHSDCWLLSMAFYFGARLNRNDRKRLFSMINDLPTLFEIVTGRKPAEDKPSAESGSKSRNNTKRSIDGQARSNSKLSYVEDEDEHGDTICGSCAGNYNADEFWIGCDICERWYHGKCVKITPAKAESIKQYKCPSCSTKKSRH

SEQ ID NO: 429 - DNA, 762 bp, Populus trichocarpa
atggacggcggggcatcttataatcctcgcacggtggaggaagtctttagggattttaaaggtcgaagagctggcatgattaaagctcttactactgatgttgaagagttttaccagcagtgtgatcctgagaaggaaaatctctgcctttatggatttcctagcgagcagtgggaggtcaatttacctgctgaagaggtgcctcctgagcttccagagcctgctttaggtatcaactttgccagagatgggatgcaagaaaaggactggttgtctctggttgctgttcacagtgatgcatggttactttctgtgtccttctattttgggtctaggtttggatttgacaaagcggatagaaaacgccttttcaacatgataaatgatcttccaacagtgtttgaggttgtgactggaacggccaagaaacaagtaaaagaaaagtcatcagtttcaaatcacagcagcaataaaactaaatcaaactctaagcgaggctctgaatcccaaggcaagttttcaaaggtaatgcaagcaaaagatgaagacggcgagggcttggatgaagaagatgaagaagagcatggagagacactatgtggtgcttgtggagaaaactatgcctctgatgagttctggatttgctgtgacatctgcgaaaagtggttccatggaaaatgtgtgaagatcaccccagcaagggctgagcatattaagcagtacaaatgcccatcttgcagcaacaaaagagcacggccttga

SEQ ID NO: 430 - protein, 253 aa, Populus trichocarpa
MDGGASYNPRTVEEVFRDFKGRRAGMIKALTTDVEEFYQQCDPEKENLCLYGFPSEQWEVNLPAEEVPPELPEPALGINFARDGMQEKDWLSLVAVHSDAWLLSVSFYFGSRFGFDKADRKRLFNMINDLPTVFEVVTGTAKKQVKEKSSVSNHSSNKTKSNSKRGSESQGKFSKVMQAKDEDGEGLDEEDEEEHGETLCGACGENYASDEFWICCDICEKWFHGKCVKITPARAEHIKQYKCPSCSNKRARP

SEQ ID NO: 431 - DNA, 768 bp, Populus trichocarpa
atggacggaggcgcccagtacaacccccgaactgtagaggaggttttcagggatcttaaaggccgtagagctggaatgatcaaagccctaactactgatgtagaagaattttatcagcggtgtgatcctgagaaggagaatctttgcctgtatgggttccctaatgaacagtgggaagtcaatttacctgctgaagaagtgcctcccgaactcccagagcctgcacttggaattaactttgccagagatgggatgcaagaaaaagactggctctctctagttgctgttcatagtgacgcgtggttgcttgctgtggctttctactttggctctagatttggttttgataaaactgataggcaaaagagaaaagggaaacgtcttttcactatgataaatgatctcccaacaatatttgagattgtaactggagctgtgaagaaacaagcaaaggagaaatcatccgtctcaaatcatagcagcaacaagtccaagtcaagctcaaaagggcgagcatcagattctgtcaagtatttgaaggggcaaccaaaggatgaggaggaaggactggatgaggaggaggaggagcacggggatactttgtgtggggcgtgtggagagaactatgctgcagatgagttctggatttgttgcgacatatgtgaaaagtggttccatggcaagtgcgtgaaaatcactcctgccagggctgagcacatcaagcagtacaaatgcccatcatgcagcaacaagagagctagaccttga

SEQ ID NO: 432 - protein, 255 aa, Populus trichocarpa
MDGGAQYNPRTVEEVFRDLKGRRAGMIKALTTDVEEFYQRCDPEKENLCLYGFPNEQWEVNLPAEEVPPELPEPALGINFARDGMQEKDWLSLVAVHSDAWLLAVAFYFGSRFGFDKTDRQKRKGKRLFTMINDLPTIFEIVTGAVKKQAKEKSSVSNHSSNKSKSSSKGRASDSVKYLKGQPKDEEEGLDEEEEEHGDTLCGACGENYAADEFWICCDICEKWFHGKCVKITPARAEHIKQYKCPSCSNKRARP

SEQ ID NO: 433 - DNA, 765 bp, Populus trichocarpa
atggaggcaataccgcacccaataccgcgaactgttgaagaagtttttagtgattttaaaggaagacgctctggtttaatcaaggctctcactaccgatgttgagaagttttaccagcagtgtgaccctgataaggagaacttgtgcctatatggactcccaaatgaaacatgggaagttaatctgcctgtggaggaggtgcctcctgagcttcctgagcctgcactaggtataaattttgctagggatgggatgcaagagaaagactggttatcccttgttgcagttcacagcgattcatggttgcttgctgttgcattttattttggtgcacgttttgggtttgggaagaatgaaaggaagaggcttttccagatgataaatgagctccccacaatattcgaggttgtgtccggaaatgttaagcaacctaaggaccaatctgccactcacaacaacagtggcaaaagcaaatcaagcgggaagatgcaatcccggcaacctgagtcccagactaaggcagtaaaggtatctgcaccacccaaggaagactatgagagtggggaagaggaagaagaagatgacgaacagggtgctacttgcggagcatgtggtgaaagctatggcactgatgaattctggatttgctgtgatatttgcgagaaatggttccatgggaaatgcgtcaagattacacctgccaaagctgagcatatcaagcagtacaagtgcccaagttgcagtggcaagagggctagagtttaa

SEQ ID NO: 434 - protein, 254 aa, Populus trichocarpa
MEAIPHPIPRTVEEVFSDFKGRRSGLIKALTTDVEKFYQQCDPDKENLCLYGLPNETWEVNLPVEEVPPELPEPALGINFARDGMQEKDWLSLVAVHSDSWLLAVAFYFGARFGFGKNERKRLFQMINELPTIFEVVSGNVKQPKDQSATHNNSGKSKSSGKMQSRQPESQTKAVKVSAPPKEDYESGEEEEEDDEQGATCGACGESYGTDEFWICCDICEKWFHGKCVKITPAKAEHIKQYKCPSCSGKRARV

SEQ ID NO: 435 - DNA, 765 bp, Populus trichocarpa
atggagggaacaccgcatcctataccgcgtaccgttgaagaagtttttagtgatttcaaaggcagacgctctggtttaatcaaggctcttacttctgatgttgagaagttttaccagcagtgtgaccctgataaggagaacttgtgtctctatggacttccaaatgagacatgggaagttaacctgcctgtggaggaggtgccccctgaacttcctgagcctgcactaggtataaattttgccagggatgggatgcaagagaaggactggttatcccttgttgcagttcacagtgattcatggttgcttgctgttgcattttattttggtgcacgttttgggtttggtaagaatgaaaggaagaggcttttccagatgataaatgagctccccacaatattcgaggccgtgtctggaaatgttaagcaacctaaggaccaaactgccactcacaacaacagtggcaaaagcaaatcaagtgggaagatgcaatcccggcaacctgagtcccagactaaggctataaaggtatctgcaccacccaaggaagactatgagagtggggaagaggaagaagaagacgatgaacagggtgctacttgtggagcatgtggtgaaagctatggaactgatgagttctggatttgctgtgatatgtgtgagaaatggttccatggaaaatgcgtcaagattacacctgccaaagctgagcacatcaagcagtacaagtgcccaagttgcagtggcaagagagctagggtttaa

SEQ ID NO: 436 - protein, 254 aa, Populus trichocarpa
MEGTPHPIPRTVEEVFSDFKGRRSGLIKALTSDVEKFYQQCDPDKENLCLYGLPNETWEVNLPVEEVPPELPEPALGINFARDGMQEKDWLSLVAVHSDSWLLAVAFYFGARFGFGKNERKRLFQMINELPTIFEAVSGNVKQPKDQTATHNNSGKSKSSGKMQSRQPESQTKAIKVSAPPKEDYESGEEEEEDDEQGATCGACGESYGTDEFWICCDMCEKWFHGKCVKITPAKAEHIKQYKCPSCSGKRARV

SEQ ID NO: 437 - DNA, 753 bp, Physcomitrella patens
atggagggggcctcgatatctgcaaatccgcgaacggttgacgaagtgtttaaggactttaagggacggcgatcgggaatgctgaaggcgcttatcactgatgttgaagacttttaccgccagtgtgatccagagaaggagaatttgtgtctgtacggtttcccggatgaggcatgggaagtaaatttaccagcagaagaggttcctcctgaacttccagaacctgcccttggtatcaacttcgctagagatggcatgcagcgtaaagattggttagccttggttgccgtgcacagcgatgcgtggctgctcgctgttgcattctattatggagctcggtttgacaagaacgagaggaagcgtttgtttaacatgataaatgagcttccaacagtatttgacgtagtaacaggaaaaaagcctgttaaggagaagcttgctgtcaataacatctctggcaccaaagccaagcctgctgcgaagcagcaggtgacgcaagcaaagccggctaagcctgctcccctacctcagaaggatgaagaggacgctcttgatgatgaggacgaggaggaacatggcgacacattctgtggaagttgtggagggccttatactgctgatgaattctggatcggctgtgatatctgtgaaaagtggtaccatggcaaatgtgtaaaaattacgccagcaagagcagaacacattaagcaatacaagtgcccatcctgcaccaacaaaagggctcgtacgtaa

SEQ ID NO: 438 - protein, 250 aa, Physcomitrella patens
MEGASISANPRTVDEVFKDFKGRRSGMLKALITDVEDFYRQCDPEKENLCLYGFPDEAWEVNLPAEEVPPELPEPALGINFARDGMQRKDWLALVAVHSDAWLLAVAFYYGARFDKNERKRLFNMINELPTVFDVVTGKKPVKEKLAVNNISGTKAKPAAKQQVTQAKPAKPAPLPQKDEEDALDDEDEEEHGDTFCGSCGGPYTADEFWIGCDICEKWYHGKCVKITPARAEHIKQYKCPSCTNKRART

SEQ ID NO: 439 - DNA, 756 bp, Physcomitrella patens
atggaaggggcatctgtatcaacaaacccccgctccgtggaggaggtctttaaggatttcagagggcgtcgagcggggatgctcaaggctcttactactgaagtagaagaattttaccggcagtgtgatccagagaaggagaatttatgtttgtatggatttccggaggaaacgtgggaggtgaacctccctgccgaagaagtacccccagagctaccggagcctgcgctggggatcaacttcgcacgagacggaatgcagcgcaaggactggctttcattggttgctgtacatagtgacgcatggctgctcgctgttgcattttattacggtgcccgatttgacaagatcgaaaggaagcggctattcaatttgattaatgagctgccaacggtatttgatgtggttaccggaaagaagcctgtgaaggaaaagagcagcgtcaataataacgttaacagcaatagcaacaataataacaacagcggcgggaacaaggcaaagtctgcggcgaaggtggtgacacctcctcctcctaaggaagacgacgatcttgaagacgaagacgaggaggagcacggagatacattctgtggcacctgtgggggaagttatacggctgaggaattctggataggttgtgacatttgtgagaaatggtatcacggaaaatgcgtgaagattacacctgcaagagcagagcacatcaagcaatacaagtgcccggcgtgtagcaacaaacgggcgcgtacgtaa

SEQ ID NO: 440 - protein, 251 aa, Physcomitrella patens
MEGASVSTNPRSVEEVFKDFRGRRAGMLKALTTEVEEFYRQCDPEKENLCLYGFPEETWEVNLPAEEVPPELPEPALGINFARDGMQRKDWLSLVAVHSDAWLLAVAFYYGARFDKIERKRLFNLINELPTVFDVVTGKKPVKEKSSVNNNVNSNSNNNNNSGGNKAKSAAKVVTPPPPKEDDDLEDEDEEEHGDTFCGTCGGSYTAEEFWIGCDICEKWYHGKCVKITPARAEHIKQYKCPACSNKRART

SEQ ID NO: 441 - DNA, 759 bp, Physcomitrella patens
atggaaggggcgtccgtgtcaactaaccctcggtccgtggacgaggtctttaaggatttcagagggcgtcgagctgggatgctcaaggctcttacttctgaggtagaggaattttatcgccaatgcgatccagaaaaggagaatttgtgtttgtatggatatccggaggagacgtgggaagtgaaccttccagccgaagaggtaccgcccgagctacccgagcctgcgctgggaatcaacttcgcacgagacggaatgcaacgcaaggactggctttcattggttgctgttcacagtgacgcatggctgcttgccgttgcgttttattacggtgctcgatttgacaagaatgaaagaaagcggctatttaattctatcaatgagctgcctacagtatttgatgtagtgaccggtaagaaacctgtgaaggaaaaagccagcgttgtcgtcaaccacaacaacaacaataacaacaataataacagtggccgaaataagacaaagtcggcggctaaggcaaagccggcaccacctcctccgaaggaagatgacgatcttgaggatgaggacgaggaggagcacggagacacattttgtggtacctgtggtggaagttatacagctgatgaattttggatagggtgtgacatctgtgaaaaatggtatcacggtaaatgtgtgaagatcacacctgcaagagcggagcacatcaagcaatacaagtgcccagcgtgcagcaacaaaagggcgcgtacgtaa

SEQ ID NO: 442 - protein, 252 aa, Physcomitrella patens
MEGASVSTNPRSVDEVFKDFRGRRAGMLKALTSEVEEFYRQCDPEKENLCLYGYPEETWEVNLPAEEVPPELPEPALGINFARDGMQRKDWLSLVAVHSDAWLLAVAFYYGARFDKNERKRLFNSINELPTVFDVVTGKKPVKEKASVVVNHNNNNNNNNNSGRNKTKSAAKAKPAPPPPKEDDDLEDEDEEEHGDTFCGTCGGSYTADEFWIGCDICEKWYHGKCVKITPARAEHIKQYKCPACSNKRART

SEQ ID NO: 443 - DNA, 753 bp, Physcomitrella patens
atggagggagcgtcgatgtcgaccaatccgcggacagtcgatgaggtttttaaggactttaaggggcggcgatcgggaatgctcaaagctctcacgaccgatgttgaagaattttatcggcagtgtgatccagagaaggagaacttgtgtttgtatggtttcccggatgaagcttgggaagtgaatttaccggcggaagaggttccaccagaacttcctgaacctgcacttggtatcaacttcgccagagatggcatgcagcgtaaagactggctttctttagttgctgtgcacagtgatgcctggctacttgctgttgctttctattacggagctcggtttgataagaacgagagaaagcgtctttttaccatgataaatgagctcccaactgtatttgacgtagtcacggggaaaaagcctgtgaaggaaaagcccgctgtcaatagctctggcaccaaagcgaaatctgctaccaaagtgcagcaggtgactcaagcaaagccggcaaaacctgctccaccacctcccaaggacgaggaggaacctcttgatgacgaggatgacgaggaacatggtgacaccttttgtggaagttgcggtggaccttataccgctgacgagttctggatcggttgcgacatctgtgagaagtggttccatggcaagtgtgtaaaaatcactccagctagagcggaacatattaagcaatacaagtgtccatcttgcagcaataaaagggcccgtacataa

SEQ ID NO: 444 - protein, 250 aa, Physcomitrella patens
MEGASMSTNPRTVDEVFKDFKGRRSGMLKALTTDVEEFYRQCDPEKENLCLYGFPDEAWEVNLPAEEVPPELPEPALGINFARDGMQRKDWLSLVAVHSDAWLLAVAFYYGARFDKNERKRLFTMINELPTVFDVVTGKKPVKEKPAVNSSGTKAKSATKVQQVTQAKPAKPAPPPPKDEEEPLDDEDDEEHGDTFCGSCGGPYTADEFWIGCDICEKWFHGKCVKITPARAEHIKQYKCPSCSNKRART

SEQ ID NO: 445 - DNA, 747 bp, Physcomitrella patens
atggaaggtgcttcagtgtccacaaaccctcggtccgtggatgaagtcttcaaggattatagggggcgccgaggaggaatgctcaaggcgctcatcgctgacgtagaagaattttatcggcaatgtgatccagaaaaggaaaacttgtgtttatacggataccctgatgaatcatgggaggttaaccttccagctgatgaagtgcccccggagctaccggagcctgcgctggggatcaacttcgcccgcgacggaatgcaacggaaggactggttgtcattagttgctgtccatagtgatgcgtggctgcttgccgtagcgttttattatggagctcgattcgacaaaaatgaaaggaagcggttgtttaatttgatcaatgagcttcctacagtgtttgatgtagtgtctgggaagaagcctgtgaaggaaaaggccagtgttaacaacaacaacaatagtaacaacaacaacaacaacaacaacaacaacaacaacagtggtggaaataaaataaagtctgctgctaaagtggatgaagactattttgaggacgacgaggaggaacatggagatacaacttgcggcacctgtggagggagttacactgctgatgagttctggatagggtgtgacatctgtgaaaaatggtatcatggaaagtgtgtgaagataactcctgcaagagcggagcacatcaagcaatacaagtgcccttcgtgcagcaacaaaagagcgcgtacgtaa

SEQ ID NO: 446 - protein, 248 aa, Physcomitrella patens
MEGASVSTNPRSVDEVFKDYRGRRGGMLKALIADVEEFYRQCDPEKENLCLYGYPDESWEVNLPADEVPPELPEPALGINFARDGMQRKDWLSLVAVHSDAWLLAVAFYYGARFDKNERKRLFNLINELPTVFDVVSGKKPVKEKASVNNNNNSNNNNNNNNNNNNSGGNKIKSAAKVDEDYFEDDEEEHGDTTCGTCGGSYTADEFWIGCDICEKWYHGKCVKITPARAEHIKQYKCPSCSNKRART

SEQ ID NO: 447 - DNA, 762 bp, Physcomitrella patens
atggaaggaggttcgatgacactcaatccgcgatcggtcgatgaggtgtttaaggacttcaaagggcggcgatcggggatgctgaaagccctcacgaccgatgtcgaagagttttatctgcagtgtgatccagaaaaggagaacttgtgtttgtatggtttcccggacgaagcctgggaagtaaatttaccagcggaggaggttccacctgaacttcctgaacctgcacttggtattaacttcgccagagatggcatgcagcgtaaagactggctttctttggttgctgtgcacagtgatgcctggctgctcgctgttgctttctactacggagctcggtttgataagaacgagaggaagcgtctttttaatatggtaaacgagctcccaactgtatttgacgtagtcacagggaaaaagcccgtgaaagacaagcctgctgttaataacaactctggcaacaaagtcaagtctgctacaaaggtggtgagtgctcaggtgactcaagcaaagcccgcaaaacctaccccaccacctcccaaggaagaagaggatcctcttgacgacgaagacgaggaggagcatggtgacactttctgtggaagttgcggagggccttataccgctgatgagttctggattggatgcgatatttgcgagaaatggtttcatggcaagtgtgtgaaaatcacaccagctagagcagaacacattaagcaatacaaatgtccttcttgcagcaacaaaagggcccgtacatag

SEQ ID NO: 448 - protein, 253 aa, Physcomitrella patens
MEGGSMTLNPRSVDEVFKDFKGRRSGMLKALTTDVEEFYLQCDPEKENLCLYGFPDEAWEVNLPAEEVPPELPEPALGINFARDGMQRKDWLSLVAVHSDAWLLAVAFYYGARFDKNERKRLFNMVNELPTVFDVVTGKKPVKDKPAVNNNSGNKVKSATKVVSAQVTQAKPAKPTPPPPKEEEDPLDDEDEEEHGDTFCGSCGGPYTADEFWIGCDICEKWFHGKCVKITPARAEHIKQYKCPSCSNKRART

SEQ ID NO: 449 - DNA, 738 bp, Physcomitrella patens
atgtcgacgaatccgcggacggtggacgaagtgttcaaggacttcaaagggcggcgattgggaatgctgaaggctcttactgccgacgtggaagagttttaccgccaatgtgatccagagaaggagaatttgtgcttatatggttttccagaagaagcatgggaagtaaatctaccagctgaagaggttcctcctgaacttccagaacctgctcttggtatcaactttgctagggacggcatgcagcgtaaagattggttgtccttggttgctgtgcacagtgatgcctggctgctcgctgttgctttttattatggtgcccggtttgacaagaacgagaggaagcgtctctttaatatgataaatgaactcccaacagtattcgacgtagtgacaggaaagaagcctgtgaaggacaagcctgctgttaataattcctctggcaccaaaaccaagtccgctacgaaggtggtgatggctcaagctaagcctgccaagcctgttccaccaattcaaaaagatgaggaggacgcctttgatgacgaggatgaggaggaacatggtgacaccttctgtggaagttgcggtgggccttatactgctgatgagttctggatcggctgcgatatctgtgagaaatggttccatggcaagtgtgtgaaaattacaccggcaagagcagaacatattaagcaatacaagtgtccatcttgcagcaacaaaagggcccgtacgtaa

SEQ ID NO: 450 - protein, 245 aa, Physcomitrella patens
MSTNPRTVDEVFKDFKGRRLGMLKALTADVEEFYRQCDPEKENLCLYGFPEEAWEVNLPAEEVPPELPEPALGINFARDGMQRKDWLSLVAVHSDAWLLAVAFYYGARFDKNERKRLFNMINELPTVFDVVTGKKPVKDKPAVNNSSGTKTKSATKVVMAQAKPAKPVPPIQKDEEDAFDDEDEEEHGDTFCGSCGGPYTADEFWIGCDICEKWFHGKCVKITPARAEHIKQYKCPSCSNKRART

SEQ ID NO: 451 - DNA, 777 bp, Saccharum officinarum
atggacggaggagccgccttcccaggcacgccgccggtgccccgctcgccggaggacgtcttccgggactaccgcgcgcgccaggccggcctgatcagggcgctcaccaccgatgtggagaagttctacgtgatgtgcgacccagagaaggagaacctatgtttatatggacttcccaatgagacttgggaagtgaacttgcctgctgaggaggtccctcctgaactcccagagccagctctgggaattaattttgctcgtgatgggatgaatgaaaaagattggctatcacttgttgcagtgcatagtgattcttggctaatgtctgttgcattttattttggagcaaggtttggattcgacaaggaatccaggaaacgtctcttcaccatgatcaataaccttcccagcatatatgaggttgtcacaggaactgccaagaaagagcccaaagaaaaaactcctaaaagcaataataagactaacaaatctggctcaaagccctcacgccaggcggaacccaactcaagggtcccaaagatgccacctccaaaggacgaggaggagagtgaaggggaggaaggggaaccacaggaagaccatgagactgcgctgtgcggcgcatgtggcctaggatatgatgacttctggatctgctgcgacttatgcgagacatggttccacggcaagtgtgtcaagatcaccccagctaaagcggagcacatcaagcagtataagtgcccctcctgcacaggaagcaagagggccaaggcttga

SEQ ID NO: 452 - protein, 258 aa, Saccharum officinarum
MDGGAAFPGTPPVPRSPEDVFRDYRARQAGLIRALTTDVEKFYVMCDPEKENLCLYGLPNETWEVNLPAEEVPPELPEPALGINFARDGMNEKDWLSLVAVHSDSWLMSVAFYFGARFGFDKESRKRLFTMINNLPSIYEVVTGTAKKEPKEKTPKSNNKTNKSGSKPSRQAEPNSRVPKMPPPKDEEESEGEEGEPQEDHETALCGACGLGYDDFWICCDLCETWFHGKCVKITPAKAEHIKQYKCPSCTGSKRAKA

SEQ ID NO: 453 - DNA, 774 bp, Saccharum officinarum
atggaccccggcgctggcgcgcactactccgcccgtaccgcggaggaggtcttccgcgacttccgcggccgtcgcgcgggcatgatcaaggccctcaccaacgatgtggagaagttctaccagctgtgcgaccccgaaaaggaaaacctgtgcctttatggctaccccaatgaaacatgggaagtaactttgccagcagaggaagtgcctccggagatccctgagccagctttgggtataaactttgctagggatggcatgaatgagaaggattggttggcgctagttgctgtccacagcgattcctggttactagctgttgcattctactttgcggcccggtttgggtttgacaaagaggccaggcggcgactcttcaacatgataaataacttgcccacgatatttgaagtagtgactggggttgccaagaaacaaaacaaggagaaaggccccaatagtaccagcaaaagcaacaaaccaagttcgaaaatgacatcaagacccgagtctcattcgaaggcgacaaaagtggcagcgccccccaaggatgacgatgatgagagcggtgaagaatatgaagaagaggaagagcgtgataacaccttatgtggatcttgtggaacaaatgacggcaaggacgaattctggatctgttgtgatagttgtgagcggtggtaccatgggaagtgtgtcaagatcacgcctgcacgagccgagcacatcaagcactacaaatgcccagattgcagcaacaagagggcaagagcctag

SEQ ID NO: 454 - protein, 257 aa, Saccharum officinarum
MDPGAGAHYSARTAEEVFRDFRGRRAGMIKALTNDVEKFYQLCDPEKENLCLYGYPNETWEVTLPAEEVPPEIPEPALGINFARDGMNEKDWLALVAVHSDSWLLAVAFYFAARFGFDKEARRRLFNMINNLPTIFEVVTGVAKKQNKEKGPNSTSKSNKPSSKMTSRPESHSKATKVAAPPKDDDDESGEEYEEEEERDNTLCGSCGTNDGKDEFWICCDSCERWYHGKCVKITPARAEHIKHYKCPDCSNKRARA

SEQ ID NO: 455 - DNA, 729 bp, Saccharum officinarum
atgggggacgccgcctccggacgcggccacgtcgtctaccctccccgctccgccgaggacatcttcaaggactaccgcgcccgctgctccgccatcctccgcgccctcactcacgatgtcgaggacttctacgcgcagtgcgatccagacaaggagaacctgtgcctgtacggctacgcgaacgaggcgtgggaggtggcgctgccggcggaggaggtgcccacggagctgccggagcctgcgctggggatcaacttcgcgcgcgacgggatgaaccgccgcgactggcttgcgctcgtcgccgtccactccgactcctggcttctctccgtcgccttttactatgccgctcggctcaaccgtaatgaccggaagcacttatttggtatgattaatgaattgcaaactgtttttgaagttgtctccggtgcaagacaacaacaatctaaagagaggtccagtatggacaatggtggcagatccaagcctgtaaagatagaaaataatggaaaagccacagacgaagcatatggagaagatgacagtgatcacggtgaaaccctttgtggaacctgtggtgggatatacagtgcggatgagttctggattgggtgcgacatatgcgagaggtggtaccatggcaagtgtgtcaagataactcccgccaaggcggagagcataaagcattacaaatgcccgagctgcagctccaagagggctaggcagtag

SEQ ID NO: 456 - protein, 242 aa, Saccharum officinarum
MGDAASGRGHVVYPPRSAEDIFKDYRARCSAILRALTHDVEDFYAQCDPDKENLCLYGYANEAWEVALPAEEVPTELPEPALGINFARDGMNRRDWLALVAVHSDSWLLSVAFYYAARLNRNDRKHLFGMINELQTVFEVVSGARQQQSKERSSMDNGGRSKPVKIENNGKATDEAYGEDDSDHGETLCGTCGGIYSADEFWIGCDICERWYHGKCVKITPAKAESIKHYKCPSCSSKRARQ

SEQ ID NO: 457 - DNA, 753 bp, Saccharum officinarum
atggatatggcccccgcgcccgtctactccaacccgcgctcggtcgaggaaatcttcaaggacttctccggccgccgcgcggggctcgtccgcgccctcacctccgatgtggacgatttctgcagcttctgcgacccagataaggagaatttgtgtctctacggccttcccaacgggacctgggaggtgtcgccgccggcggacgaggttcctccggagttgcccgagccggcgctcggcatcaattatgcgcgtgacggcatgcagcaccgcgactggctgtcactcgtcgcggtccactctgactcgtggctcatctccgtcgctgtcttctacggtgctcgcctcaacgccaacgaccggaagcgcttattcagcttgatcagtgatcttccttctgtctttgaagcattcgcggacaggaaacacggcagagataggtctggggttgatagcagtggcaagtccagacactcattaaagagaggaaacgatggccatacgaagaattccagggcagcagcttctgctgccaaagagtatgacgacgacgatgacgaggaagacgaggaacacacggaaaccttttgtggaagctgcggcggcctttacaacgcgaacgagttctggatcggctgcgacatatgtgagcggtggttccacggcaagtgtgtgcggatcacccctgccaaagcggagcacataaagcactacaagtgcccggactgcagctcgaagaaaatgaggcagtaa

SEQ ID NO: 458 - protein, 250 aa, Saccharum officinarum
MDMAPAPVYSNPRSVEEIFKDFSGRRAGLVRALTSDVDDFCSFCDPDKENLCLYGLPNGTWEVSPPADEVPPELPEPALGINYARDGMQHRDWLSLVAVHSDSWLISVAVFYGARLNANDRKRLFSLISDLPSVFEAFADRKHGRDRSGVDSSGKSRHSLKRGNDGHTKNSRAAASAAKEYDDDDDEEDEEHTETFCGSCGGLYNANEFWIGCDICERWFHGKCVRITPAKAEHIKHYKCPDCSSKKMRQ

SEQ ID NO: 459 - DNA, 732 bp, Vitis vinifera
atggaaatggcttctatttcttcgagtccgaggactgtagaggagatcttcaaggattacagcggtcgtagagctggtgttgtgcgtgccttaacctacgatgttgatgaattctacaagctctgcgatccagagaaagagaatttgtgtctgtatggacatccaaatgatacttgggaagtaactcttccagcagaggaagttcctccagagctccctgagccagcgcttgggatcaattttgcgagagatggcatgaaccgcaaagactggctttcactggttgctgtgcacagtgattcttggttgctctctgcagctttctatcttggtgctcgccttaaccgcaatgaaaggaaacgtctatttagtatgatcaatgatctgcccactgtctttgaagttgtaacagagaggaagcctataaaagacaagcctagtgtggatagtggaagcaaatctcgagtcagcacaaagagggggaatgaagggcaagtgaaaagcaccccaaagctggcagcagatgagagctttgaggaggaggaagatgaacatagtgaaaccctctgtgggagctgtggtgggaactacaatgctgatgagttctggattgggtgcgacatctgtgagaggtggttccatggaaagtgtgtgaagataacacctgccaaggctgagagcattaagcaatataagtgtccatcttgcagcttaaagaggagcaggcagtag

SEQ ID NO: 460 - protein, 243 aa, Vitis vinifera
MEMASISSSPRTVEEIFKDYSGRRAGVVRALTYDVDEFYKLCDPEKENLCLYGHPNDTWEVTLPAEEVPPELPEPALGINFARDGMNRKDWLSLVAVHSDSWLLSAAFYLGARLNRNERKRLFSMINDLPTVFEVVTERKPIKDKPSVDSGSKSRVSTKRGNEGQVKSTPKLAADESFEEEEDEHSETLCGSCGGNYNADEFWIGCDICERWFHGKCVKITPAKAESIKQYKCPSCSLKRSRQ

SEQ ID NO: 461 - DNA, 759 bp, Vitis vinifera
atggatggtggaccgcagtacaatcctcgaactgtagaagaggttttcagggattttaagggtcgcagagcgggcatgatcaaagccctcaccactgatgttgaagagttctaccagcaatgcgatcccgagaaggaaaatctttgcctttatggattccctaatgaactgtgggaagttaatttacctgctgaagaggtgccgcctgagctccctgaacctgccttaggtattaattttgccagagatgggatgcaagaaaaggactggttgtctctggttgctgtgcacagtgatgcttggttacttgctgtggccttctattttggtgccaggtttggttttgataaagctgacaggaaacgtcttttcaatatgattaatgatcttccaacaatatttgaggttgtgactggagctgcaaagaaacaagtaaaggagaagtcatcagtttcgaaccatagcagcaacaaatccaagtcaaactcgaaagtgagaggatctgaatcagctaaatatttaaagggtgggcagccaaaggatgaggaagaaggattggatgaggtagatgaggaggagcatggggataccttgtgtggtgcttgcggagagaactatgcttcagatgaattctggatatgctgcgacatatgtgagaaatggttccatgggaagtgtgtgaagatcacccctgcgagggctgagcacatcaaacagtacaagtgcccctcatgcagcaacaagagagcaaggccttga

SEQ ID NO: 462 - protein, 252 aa, Vitis vinifera
MDGGPQYNPRTVEEVFRDFKGRRAGMIKALTTDVEEFYQQCDPEKENLCLYGFPNELWEVNLPAEEVPPELPEPALGINFARDGMQEKDWLSLVAVHSDAWLLAVAFYFGARFGFDKADRKRLFNMINDLPTIFEVVTGAAKKQVKEKSSVSNHSSNKSKSNSKVRGSESAKYLKGGQPKDEEEGLDEVDEEEHGDTLCGACGENYASDEFWICCDICEKWFHGKCVKITPARAEHIKQYKCPSCSNKRARP

SEQ ID NO: 463 - DNA, 726 bp, Vitis vinifera
atggcttccatcgactccagtcctcgcaccgttgaagacattttcaaggactacaaagctcgacgcagcggcgtagttcaagctctcaccttcgatgtcgacgaattctacgcgctatgcgatccagagaaggagaatttgtgtttgtacggacatccgaatgggtcatggcatgtggctatgccagcggaggaagttccgcctgagctgccggagccggctttagggattaattttgcaagagatgggatgaaccggagagactggcttgcgttagttgctgtgcatagtgattcttggttgctttctgtggcattttattttggtgctagccttaaccgtaacgacaggaagcggctatttagcatgataaacgatctgcccactgtctttgaagctgtaacccaaggaaaacttgtcaaagacaaacccactatggatagtggaagcaaatcgaagagtagcacgaagagatcaattgatggccaggtgagaaatgacctaaggccacgagatgagggctatgtggaggatgacgatgaacacagtgaaaccctttgtggtagctgtgggggaaattacaatgctgatgagttctggatcggctgtgacatctgtgagaggtggttccatggaaagtgcgtgaagataacaccagccaaggctgaaagtatcaagcagtataaatgcccttcttgcagcttgaagaagggcaggctgaactaa

SEQ ID NO: 464 - protein, 241 aa, Vitis vinifera
MASIDSSPRTVEDIFKDYKARRSGVVQALTFDVDEFYALCDPEKENLCLYGHPNGSWHVAMPAEEVPPELPEPALGINFARDGMNRRDWLALVAVHSDSWLLSVAFYFGASLNRNDRKRLFSMINDLPTVFEAVTQGKLVKDKPTMDSGSKSKSSTKRSIDGQVRNDLRPRDEGYVEDDDEHSETLCGSCGGNYNADEFWIGCDICERWFHGKCVKITPAKAESIKQYKCPSCSLKKGRLN

SEQ ID NO: 465 - DNA, 762 bp, Vitis vinifera
atggagggactgccaccacacccggtacccagaactgttgaagaggtcttcagcgattacagaggcagacgtgccggcttgatcaaggccctcaccaccgaagttgaaaagttctaccagcagtgcgatcctgagaaggagaacttgtgtctgtatggacttccaaatgagacatgggaagttaacctgcctgttgaggaggtacctcctgagcttccagaaccagcattaggtataaactttgctagggatgggatgcaagagaaagactggttatcactggttgctgtgcacagtgattcatggttgcttgctgttgcattctattttggtgcccgctttgggtttggtaagagtgaaaggaagaggcttttccagatgataaacgagcttccaaccatatttgaagttgtgacaggagttaagcaacaaagagatatgtctggtaatcacaacaacagcaacaaaagcaaatcaagtgggaagatgtctcggcaacctgaaccccagaccaagggagtaaaggtgtctcctccatccaaggaagaagacgagagtggggacgaagatgctgaagatgatgaacaaggagccatctgtggagcttgtggggataactatgctaatgatgaattctggatttgctgtgacgtgtgtgagaaatggttccatggcaaatgtgttaagattacacctgcaaaggctgagcatatcaagcaatacaagtgcccgggttgcagtaacaaaagggctagagtttaa

SEQ ID NO: 466 - protein, 253 aa, Vitis vinifera
MEGLPPHPVPRTVEEVFSDYRGRRAGLIKALTTEVEKFYQQCDPEKENLCLYGLPNETWEVNLPVEEVPPELPEPALGINFARDGMQEKDWLSLVAVHSDSWLLAVAFYFGARFGFGKSERKRLFQMINELPTIFEVVTGVKQQRDMSGNHNNSNKSKSSGKMSRQPEPQTKGVKVSPPSKEEDESGDEDAEDDEQGAICGACGDNYANDEFWICCDVCEKWFHGKCVKITPAKAEHIKQYKCPGCSNKRARV

SEQ ID NO: 467 - DNA, 768 bp, Zea mays
atggacggcgacggaggaggcgctggtgcgctgcaccaccacacgcgctcacccgaggacgtcttccgcgatttccgcgcgcgccgagccggcatcgtcaaggcgctcaccacggatgtggagaagttctatcagcagtgcgatccagagaaagagaacttgtgcctttatggtttgccaaatgagacttgggaggtcactcttccagctgaggaagtacctcctgagcttccagaaccagcactggggataaactttgcccgtgatggaatggtcgaaaaagactggttgtctctagttgcagttcatagtgatgcatggctcctgtctgttgcattctattttggagctcgttttggatttgacaaagatgccaggagaaggctcttcaccatgattaacaacctgcccactgtttatgaagttgtgacgggggttgctaagaagcaatcgaaagcccccaacggcagcagcaaaagcagcaaacctaactctaaaccatcaaaactgaccaattctaacagtaagcccgcgaagccagcccacccaaaagaagaggaggacagcggccgggaggacgcagaggaggaccaggcgtacctgtgtgggtcctgtggggagagctatgcgaacggggagttctggatctgctgcgatgtgtgcgagaagtggttccatggcaagtgtgtccgcatcacccctgccaaggcggagcacatcaagcagtacaagtgtcccagctgcagcaccaagcggagccgagaatga

SEQ ID NO: 468 - protein, 255 aa, Zea mays
MDGDGGGAGALHHHTRSPEDVFRDFRARRAGIVKALTTDVEKFYQQCDPEKENLCLYGLPNETWEVTLPAEEVPPELPEPALGINFARDGMVEKDWLSLVAVHSDAWLLSVAFYFGARFGFDKDARRRLFTMINNLPTVYEVVTGVAKKQSKAPNGSSKSSKPNSKPSKLTNSNSKPAKPAHPKEEEDSGREDAEEDQAYLCGSCGESYANGEFWICCDVCEKWFHGKCVRITPAKAEHIKQYKCPSCSTKRSRE

SEQ ID NO: 469 - DNA, 771 bp, Zea mays
atggaccccggcgccggcgcacactactccgcccgtaccgcggaggaagtcttccgcgatttccgcggccgccgcgcgggcatgatcaaggccctcaccaacgatgtggagaagttctaccagctgtgcgaccccgaaaaggaaaacttgtgcctttatggctaccccaacgaaacatgggaagtaactttgccagcagaggaagttcctccagagatccctgaaccagctttgggtataaactttgctagggatggcatgaacgataaggattggttggcgttagttgctgtccacagcgatgcctggttactagctgttgcattctactttgcagcccggtttgggtttgacaaagaggccaggcggcgactcttcaacatgataaataacttgcccacaatatttgaagtagcgactggggttgccaagaaacaaaacaaggagaaggaacccaatagtaccagcaaaagcaacaaaccaagttcgaaaatgacaacaagacccgagtctcatttgaaggcgacaaaagtggcaccccctaaggatgaagatgatgagagcggtgaagagtatgaagaagaggaagtgcgtgataacaccttatgtggatcctgtggaacaaatgacggcaaggacgaattctggatctgttgtgatagttgcgagcggtggtaccatgggaagtgtgtcaagatcacgcctgcacgagctgagcacatcaagcactacaaatgcccagattgcagcaacaagagggcaagagcctag

SEQ ID NO: 470 - protein, 256 aa, Zea mays
MDPGAGAHYSARTAEEVFRDFRGRRAGMIKALTNDVEKFYQLCDPEKENLCLYGYPNETWEVTLPAEEVPPEIPEPALGINFARDGMNDKDWLALVAVHSDAWLLAVAFYFAARFGFDKEARRRLFNMINNLPTIFEVATGVAKKQNKEKEPNSTSKSNKPSSKMTTRPESHLKATKVAPPKDEDDESGEEYEEEEVRDNTLCGSCGTNDGKDEFWICCDSCERWYHGKCVKITPARAEHIKHYKCPDCSNKRARA

SEQ ID NO: 471 - DNA, 870 bp, Zea mays
atgatgccacgaatgcaaaaatctcaccgcgcggtactcaccttaaatgacgggcggtgtcagacctctgaccagaaccagaaccagaacccccccgctgcgcaaccggaggcgtctcccagccccgcgccgccgctgacggagacgtccggacccgtctcctcagcgccccggaccgtcgaggacatctacaaggactacgccgcccgccgcgccggcctcgtccgcgccctcacatctgatgtcgacgggttctacagcatgtgcgacccagagaaggagaacctgtgcctgtacggtctcccgaacggcggctgggaggtatcgctgccggtggaggaggtgccgccggagatgcccgaaccagcgctagggatcaacttcgccagggacggcatgaggcgtcgcgactggctctcgctcgtcgccgtacactctgacgcttggctcgtctccgtcgcattcttcttcgccgccaaactcaacggcaacgacaggaagcgattattcaacatgattaatgatcatccatctgtgtatgaaataatggctgaccggaagggaagggagaataatcctggtgttgataacagcagcaaatccaggcactcaacgaagcgatcaaatgatggaaagataaagaactcaagagtggcagttggtgaatgtaggtatgagaatgatgaagaccacagcgaaaccctttgtggttcttgcagtggtctctacaactcaagtgagttctggattggatgcgacatttgtgagcggtggttccacggcaaatgtgtgaggataaccccagcaaaagcagaacagataaagcactacaagtgccctgattgcagctacaaaaagagcaggcaataa

SEQ ID NO: 472 - protein, 289 aa, Zea mays
MMPRMQKSHRAVLTLNDGRCQTSDQNQNQNPPAAQPEASPSPAPPLTETSGPVSSAPRTVEDIYKDYAARRAGLVRALTSDVDGFYSMCDPEKENLCLYGLPNGGWEVSLPVEEVPPEMPEPALGINFARDGMRRRDWLSLVAVHSDAWLVSVAFFFAAKLNGNDRKRLFNMINDHPSVYEIMADRKGRENNPGVDNSSKSRHSTKRSNDGKIKNSRVAVGECRYENDEDHSETLCGSCSGLYNSSEFWIGCDICERWFHGKCVRITPAKAEQIKHYKCPDCSYKKSRQ

SEQ ID NO: 473 - DNA, 726 bp, Zea mays
atggcggacgccgcctctggccgcggccacgtcgtctaccctccccgctccgccgaggacatcttcaaggactaccgcgcccgtcggtccgccatcctccgcgccctcactcacgaggtcgaggacttctacgcgcagtgcgatccagacaaggagaacctgtgcctgtacggctacgcgaacgaggcgtgggaggtggcgctgccggcagaggaggtgcccacggagctgccggagcctgcgctggggatcaacttcgcgcgcgacggaatgaaccgccgcgactggcttgcgctcgtcgccgtccactccgactcgtggctcctctccgtcgccttttactatgccgctcggcttaatcgtaatgaccggaagcgcttatttggtatgattaatgaattgcaaactgtttttgaagttgtctccggtgcgagacaacaacaatctaaagagaggtccagtatggacaatggtggtagagccaagcctgtaaagatagaaaataatggaaaagtcacagacgaagcatacgaagatgacagtgatcacggtgaaaccctatgtggaacctgtggtgggatatacaacgcggatgagttttggatcgggtgtgacatgtgcgagcgatggtaccatggcaagtgtgtcaagataactcctgccaaggcagagagcataaagcattacaaatgcccgagctgcagctccaagagggcgaggcagtag

SEQ ID NO: 474 - protein, 241 aa, Zea mays
MADAASGRGHVVYPPRSAEDIFKDYRARRSAILRALTHEVEDFYAQCDPDKENLCLYGYANEAWEVALPAEEVPTELPEPALGINFARDGMNRRDWLALVAVHSDSWLLSVAFYYAARLNRNDRKRLFGMINELQTVFEVVSGARQQQSKERSSMDNGGRAKPVKIENNGKVTDEAYEDDSDHGETLCGTCGGIYNADEFWIGCDMCERWYHGKCVKITPAKAESIKHYKCPSCSSKRARQ

SEQ ID NO: 475 - DNA, 792 bp, Hordeum vulgare
atggatggcgccggcgcaggaggggcgtacgtcgcgcgcacggcggaggaggtcttccgcgacctccgcggccgccgcgccggcatgatcaaggccctcaccgaagatgtggacaagttcttcaagctctgcgaccctgaaaaggagaacttgtgcctttatggatatcccaatgagacatgggaagtgaccttgccagctgaggaagtgcccccagagatccctgaaccagcattaggaatcaacttcgctagggatggaatgaatgagaaggattggttggcgctagttgcagttcacagtgattcctggttactgtccgtcgcattctactttggagcccgctttggcttcgacaaagacaataggaggcgactgttcaacatgataaacaacttgcccactatatacgaggtagtgacaggaattgccaagaagcagtcaaaggagaagactccgaacagcagtagcaagagcagcaagcccagtatgaaagtgctgtcgagagccgagccccgtgcaaaggcgaaggtgccggcccccaaggacgaggaggagagcggcgaggacgagggcgacgacgaggaggaggagcacgacaacactctttgcgggacttgcggcaccaatgacggcaaggacgagttctggatctgctgcgacaactgcgagaagtggtaccacggcaagtgcgtcaagatcacgcccgcccgggcggagcacatcaagcactaccggtgcccggagtgcaccaacggcggctccaacagcaacaagagggtcaagacatga

SEQ ID NO: 476 - protein, 263 aa, Hordeum vulgare
MDGAGAGGAYVARTAEEVFRDLRGRRAGMIKALTEDVDKFFKLCDPEKENLCLYGYPNETWEVTLPAEEVPPEIPEPALGINFARDGMNEKDWLALVAVHSDSWLLSVAFYFGARFGFDKDNRRRLFNMINNLPTIYEVVTGIAKKQSKEKTPNSSSKSSKPSMKVLSRAEPRAKAKVPAPKDEEESGEDEGDDEEEEHDNTLCGTCGTNDGKDEFWICCDNCEKWYHGKCVKITPARAEHIKHYRCPECTNGGSNSNKRVKT

SEQ ID NO: 477 - DNA, 795 bp, Hordeum vulgare
atggacgtcggcgccggcgccggcgcgccctacgcctcccgcacggcggaggaggtcttccgcgacttccgcggccgccgcgccggcatgatcaaggccctcacccaagaagtggacaagttctaccagctctgcgaccccgaaaaggagaacttgtgcctttatgggtaccctaatgaaacatgggaagtgacgttgccagctgaggaagtccccccagagattcctgaaccagcacttggaatcaactttgctagggatggcatgaacgagaaggattggttagcactagttgctgttcacagtgattcctggttgttggctgtttcattctacttcgcggcacggtttggatttgacaaagaggcaaggaggcgtctctttaacatgataaataacctgcctacaatatttgaagtcgtgactggtgctgcaaagaagcagaccaaggagaaggcccccaacaccaacactacgcacaagagcaataataacaagccaagcatgaaaactctatcaaggcctgagtcccagtcaaagcccccaaagatggcagcgcccccaaaggatgaagacgagagcggcgaggactatggagaagaagaggaggaagagcgcgacaacaccttgtgtggtacctgtggaacaaacggcggtaaggatgagttctggatttgctgcgacaactgcgagcgttggtatcatgggaaatgcgtcaagatcacgcctgctcgagccgagcacatcaagcactacaagtgcccagactgcagcaacaagagggcgagggtgtaa

SEQ ID NO: 478 - protein, 264 aa, Hordeum vulgare
MDVGAGAGAPYASRTAEEVFRDFRGRRAGMIKALTQEVDKFYQLCDPEKENLCLYGYPNETWEVTLPAEEVPPEIPEPALGINFARDGMNEKDWLALVAVHSDSWLLAVSFYFAARFGFDKEARRRLFNMINNLPTIFEVVTGAAKKQTKEKAPNTNTTHKSNNNKPSMKTLSRPESQSKPPKMAAPPKDEDESGEDYGEEEEEERDNTLCGTCGTNGGKDEFWICCDNCERWYHGKCVKITPARAEHIKHYKCPDCSNKRARV

SEQ ID NO: 479 - DNA, 774 bp, Hordeum vulgare
atggacgcctcctaccgccgttcaggtgcgggcggcggcggcggctcagccccccgcactgtcgaggacatcttcaaggactaccgcgcccgccgcaacgccatccaccgcgctctcacccacgacgtcgaggagttctacgcgcagtgcgatccagagaaggagaacttgtgcctgtacgggtacgccaacgaggcgtgggaggtggcgctgcccgcggaggaggtgcccaccgagctgccggagccggcgctcgggatcaactttgcgcgcgacggcatgaagcgcagagactggctcgcgctcgtcgccgtccactccgattcgtggcttgtctccgtagccttctactatgccgcgcggctcactcgcaacgaccggaagcgtttatttggcatgatgaatgatttgccaaccgtgtatgaagtcatctcaggcatgagacaatcgaaggagagggacagatcgggtggtattgacaacagcggtagaaacaagctgccatcaaagcatacagtcgaggcggtgccgccaccacgtgcagaaaataatgccagggaggccgacgaaggttatgatgaagatgacggcgaccacagcgagaccctatgtgggacatgcggcggcatatacagcgccgaggaattctggatcgggtgcgacgtgtgcgagaggtggtaccatggcaagtgcgtgaagataactccagcgaaggcggagagcataaagcagtacaaatgcccaagctgcagctccaagagacctaggcagtag

SEQ ID NO: 480 - protein, 257 aa, Hordeum vulgare
MDASYRRSGAGGGGGSAPRTVEDIFKDYRARRNAIHRALTHDVEEFYAQCDPEKENLCLYGYANEAWEVALPAEEVPTELPEPALGINFARDGMKRRDWLALVAVHSDSWLVSVAFYYAARLTRNDRKRLFGMMNDLPTVYEVISGMRQSKERDRSGGIDNSGRNKLPSKHTVEAVPPPRAENNAREADEGYDEDDGDHSETLCGTCGGIYSAEEFWIGCDVCERWYHGKCVKITPAKAESIKQYKCPSCSSKRPRQ

SEQ ID NO: 481 - DNA, 717 bp, Glycine max
atggaaatgacttcgactccccgcacagtcgaagagatcttcaaggactacaccgcccgcagaactgccatcgttcgcgctctctctcaagatgtggatgaattctacggactctgcgatccagataaggagaacttgtgcctctatggacatccaaacgaaacatgggaggtgactttgccggcagaggaagttccaccagagcttccggagcctgcactcggaatcaattttgctagggatggcatgaaccgcagggactggctttctctggttgctgtgcacagtgattcgtggttgctctctgtggccttctatcttggagctcgtcttaaccgcaacgaaaggaaacgtttatttagcttgatcaatgatcttcctactgtttttgaagttgtgacagagaggaagccagtaaaggacaagcccactgcagatagtggaagcaagtctaggggcagcaccaagagatcaagtgatgggcaagttaaaagcaacccaaaattcgcagatgaaggttatgaagaggaggatgagcacagtgaaaccctttgtggtagctgcggcggaaactacaatgccgatgaattttggattggctgtgatatatgtgagaggtggttccatgggaaatgtgtgaagattactcctgcaaaagctgaaagcataaagcaatacaaatgtccttcgtgcagcttgaggcggggcaggccctaa

SEQ ID NO: 482 - protein, 238 aa, Glycine max
MEMTSTPRTVEEIFKDYTARRTAIVRALSQDVDEFYGLCDPDKENLCLYGHPNETWEVTLPAEEVPPELPEPALGINFARDGMNRRDWLSLVAVHSDSWLLSVAFYLGARLNRNERKRLFSLINDLPTVFEVVTERKPVKDKPTADSGSKSRGSTKRSSDGQVKSNPKFADEGYEEEDEHSETLCGSCGGNYNADEFWIGCDICERWFHGKCVKITPAKAESIKQYKCPSCSLRRGRP

SEQ ID NO: 483 - DNA, 720 bp, Glycine max
atggacatggcttccagtccccgcaccgtagaagagatcttcaaggattacagcgccagaagaacctctgttattcgcgctctcactcacgacgttgatgaattttacggcctctgtgatccagataaggataacctgtgcctctatggacatccaaatgaggcctgggaagtaactctgccagcggaggaagttccgccagagctcccggagccggctcttggaatcaattttgctagggatggcatgaaccgcagggactggctttctctggttgctgtccacagtgattcatggttggtttctgtggccttttaccttggggctcgtcttaaccgcaatgaaaggaaacgattatttagcttgatcaatgatcttccatctgtttttgaagttgtgactgacaggaaaccagttaaggacaagccaactgcggatagtggaagcaagtctaggggaagtgccaagagatctagcgatgggcaagttaaaagcaacccaaagtttgtagatgagggttatgaggaggatgaagatgagcataatgaaacactttgtggaagctgcggcggaaattacaacgctgatgagttttggatttgctgtgacatatgtgagaggtggttccatgggaagtgtgttaagattacccctgcaaaggctgagagcataaagcaatataaatgtccatcatgcagcctgaggcggggcaggccatag

SEQ ID NO: 484 - protein, 239 aa, Glycine max
MDMASSPRTVEEIFKDYSARRTSVIRALTHDVDEFYGLCDPDKDNLCLYGHPNEAWEVTLPAEEVPPELPEPALGINFARDGMNRRDWLSLVAVHSDSWLVSVAFYLGARLNRNERKRLFSLINDLPSVFEVVTDRKPVKDKPTADSGSKSRGSAKRSSDGQVKSNPKFVDEGYEEDEDEHNETLCGSCGGNYNADEFWICCDICERWFHGKCVKITPAKAESIKQYKCPSCSLRRGRP

SEQ ID NO: 485 - DNA, 804 bp, Tagetes elongatus
gccacacacatcgtacaaaattcaaatccaacatcgatcgagatctccgttatttggttcctatggacatggcttcaatttcttcttgccctcgtaccgttgaacagatcttcaaagattataccggtcgtcgtgccgctgttcttcgtgctttaactcacgatgttgatgcattttatggactttgcgatccagaaaaggataatctttgtctgtatggtcacccgaatgagagctgggaagttaatgttccggcggaacaagttcctgctgagcttcctgaaccagctattgggattaactttgctagagatggaatgaatagaaaggattggcttacgttggttgcggttcatagcgattgttggttgctctcagttgctttttattttggtgcccgattgaatcgaaacgaaaggaagcgtctgtttgagttgattaataatatgcccaacgcgtatgaagctgtaacaggaaggaaccctgtaaacgacaagcctagtgctgatggtggaagcaaatataagggcactgtaaagaaatcaagtgatggacatgttaaaagcacccaaaagatggccgaagagagtaacgaagaagatgaagatgagcatggtgacacaaaatgtggcagttgtggtggaaactataatggagatgagttttggattggatgtgacatttgtgagaggtggtatcacggcaagtgtgtgaaaataacacctgccaaggccgagaccattaatcagtacaaatgcccattatgtaccaacatgaaacgggcaagaacatagtaaccgaaac

SEQ ID NO: 486 - protein, 243 aa, Tagetes elongatus
MDMASISSCPRTVEQIFKDYTGRRAAVLRALTHDVDAFYGLCDPEKDNLCLYGHPNESWEVNVPAEQVPAELPEPAIGINFARDGMNRKDWLTLVAVHSDCWLLSVAFYFGARLNRNERKRLFELINNMPNAYEAVTGRNPVNDKPSADGGSKYKGTVKKSSDGHVKSTQKMAEESNEEDEDEHGDTKCGSCGGNYNGDEFWIGCDICERWYHGKCVKITPAKAETINQYKCPLCTNMKRART

SEQ ID NO: 487 - DNA, 819 bp, Triticum aestivum
atggacgcgcagtacaaccccaggacggtggaggaggtcttccgggattacaagggccgccgcaacggcctcgcccgcgcgctcaccaccgatgtggaggaattcttccggcaatgcgacccggaaaaagaaaatttgtgcctttatgggtttcccaatgagcattgggaagtaaacttacctgctgaagaagtgccacctgagctcccagagccagcattgggcatcaactttgcacgagatggaatgcaggaaaaagattggctatccatggttgcagtacacagcgacgcatggttactatctgttgcattctactttggtgctcgattcggatttgataaaagtgacaggaagcgcctgtttggtatgattaatgagcttcccacgatttttgatgttgttagtgggaagagtaaaaccaaggctccgaccaacaataaccacagcaatagcaaatccaagtccaacaataaaatgaaaacctcggagcctcgggcgaaggagcccaagccccagctgaaggaggaagatcacgaggacgaagccccggatgcgggcgaggatggtggaggcgccgccggtggtggtggtggcggggaagagcacggcgatacgctgtgcggcgcgtgtggggacaactacgggcaggacgagttctggatcggctgcgacatgtgcgagaagtggttccacggcaagtgtgtcaagatcacgccggccaaggcggaccacatcaagcagtacaagtgcccgtcgtgcatgggcgccaacggcggcggcagcggcagcaacaagcgggcgcgcccgtcctcctaa

SEQ ID NO: 488 - protein, 272 aa, Triticum aestivum
MDAQYNPRTVEEVFRDYKGRRNGLARALTTDVEEFFRQCDPEKENLCLYGFPNEHWEVNLPAEEVPPELPEPALGINFARDGMQEKDWLSMVAVHSDAWLLSVAFYFGARFGFDKSDRKRLFGMINELPTIFDVVSGKSKTKAPTNNNHSNSKSKSNNKMKTSEPRAKEPKPQLKEEDHEDEAPDAGEDGGGAAGGGGGGEEHGDTLCGACGDNYGQDEFWIGCDMCEKWFHGKCVKITPAKADHIKQYKCPSCMGANGGGSGSNKRARPSS

SEQ ID NO: 489 - DNA, 765 bp, Triticum aestivum
atggacgggggaggcacgcatcgcacgccggaggacgtgttcagggatttccgcgcgcggcgggccggcatgattaaggcgctcaccaccgatgtggagaagttctatcagcagtgcgacccagagaaagagaatctatgtctgtatggtcttcccaatgaaacatgggaagtgaacttgcctgcagaggaggttcccccagaacttccagagccggcactgggaattaattttgctcgggatgggatggatgagaaagattggttgtcacttgttgcggtgcacagtgatgcctggttgctagcagtagccttctactttggagcaagattcgggtttgacaaagaatccaggaagcggctttttagcatgataaacaacctccccaccatatatgaggttgtcaccggaactgcgaagaagcaggtcaaagaaaaacaccccaaaagcagcagcaagataaataaatctggcactaagccatctcgccagccagaacccaactcaaggggtccaaagatgccaccacctccgaaggatgaggacgacagtggaggcgaggaagaagagggagaagaacatgaaaaggcattatgtggtgcgtgtaacgataactatggacaggatgaattctggatctgctgtgatgcttgtgagacatggttccacggtaagtgtgtgaagatcacccctgccaaagctgagcacatcaagcactacaaatgcccaaattgcagcagcagtagcaagagggccagagcatga

SEQ ID NO: 490 - protein, 254 aa, Triticum aestivum
MDGGGTHRTPEDVFRDFRARRAGMIKALTTDVEKFYQQCDPEKENLCLYGLPNETWEVNLPAEEVPPELPEPALGINFARDGMDEKDWLSLVAVHSDAWLLAVAFYFGARFGFDKESRKRLFSMINNLPTIYEVVTGTAKKQVKEKHPKSSSKINKSGTKPSRQPEPNSRGPKMPPPPKDEDDSGGEEEEGEEHEKALCGACNDNYGQDEFWICCDACETWFHGKCVKITPAKAEHIKHYKCPNCSSSSKRARA

SEQ ID NO: 491 - protein, 81 aa, Artificial sequence
  Conserved domain of SEQ ID NO: 348
PRTVEEIFKDFSARHAAVLRALTTDVEDFYSQCDPERDNLCLYGHPNESWEVAVPAEEVPPELPEPVLGINFARDGMERRD

SEQ ID NO: 492 - protein, 51 aa, Artificial sequence
  PHD-zf (IPR001965) of SEQ ID NO: 348
LCGSCGTNGNEDEFWIGCDICEKWYHGKCVKITPAKAQSIKEYRCPSCSNK

SEQ ID NO: 493 - protein, 21 aa, Artificial sequence
  TMHMM predicted transmembrane domain of SEQ ID NO: 348
WLSLVAMHTDSWLLSVAFYFG

SEQ ID NO: 494 - DNA, 2194 bp, Oryza sativa; identical to SEQ ID NO: 128

SEQ ID NO: 495 - DNA, 54 bp, Artificial sequence; identical to SEQ ID NO: 343
  primer prm09483

SEQ ID NO: 496 - DNA, 50 bp, Artificial sequence; identical to SEQ ID NO: 344
  primer prm09484

SEQ ID NO: 497 - DNA, 1222 bp, Arabidopsis thaliana
cggctaatttcgacttttgtagatctttttctgctctttctctctctctctctctctctctctctctctctctctctcttgtattatttctatctcccccgccgtcgaaagagaaacgtcgatcggagaacctttgaaatgtcgactggattagatatgtctctcgacgacatgatcgccaagaaccgtaagtctcgtggtggagccggccccgctcgtggaaccggatccggatccggaccgggtccgactcgccgcaacaaccctaatcggaaatcaacccgatctgctccataccaatcagccaaggcgccggagtccacctggggtcacgacatgttctccgatagatctgaagatcaccgatcgggacgttcctccgccggaatcgaaactggaaccaagctctacatttccaatttggattacggtgtcatgaacgaagacatcaaggaactgtttgctgaagttggagaacttaaacgctacacagttcattttgatagaagtggaagatcaaagggaactgctgaagtagtgtattctcggcgtggcgatgcactcgcagctgtgaagaagtataatgatgttcagctggatggaaaacccatgaagatagagattgtgggcactaatcttcaaactgctgcagccccgtctggtagacctgcgaatggaaactccaatggtgctccatggaggacaagggagaggaggtcaacaacgaggtggtggacgaggaggcggtggccgaggtggtggtggtcgtggtaggcgtcctggtaagggccctgcagagaagatttctgcggaagatcttgatgcggatcttgataagtaccattctggagatatggagacaaactaaggaacgtgactgatcttctcaaaccggtaggggttttaggaggaagagaatcgagaaaatgtttgccagaggctttaccacttagcgcctttttggctgtgttgttcatttgtttcattagaatgactttacagaattgagaatatgtgttatttaaagttgttgtctatcttaataccctcaagtgaaaggcagaggaaggaataccaatttcgtttacagatcatatgcaggcaaaagagttttcagaaatcaggtttagttacttgtattgtgtctcttatccaagccatgccttgtggtattatgagcgcagaattttgattgaatattgttcatttgcattaaagtatc

SEQ ID NO: 498 - protein, 211 aa, Arabidopsis thaliana
MSTGLDMSLDDMIAKNRKSRGGAGPARGTGSGSGPGPTRRNNPNRKSTRSAPYQSAKAPESTWGHDMFSDRSEDHRSGRSSAGIETGTKLYISNLDYGVMNEDIKELFAEVGELKRYTVHFDRSGRSKGTAEVVYSRRGDALAAVKKYNDVQLDGKPMKIEIVGTNLQTAAAPSGRPANGNSNGAPWRTRERRSTTRWWTRRRWPRWWWSW

SEQ ID NO: 499 - DNA, 750 bp, Nicotiana benthamiana
atgtcaaatctggatgtatctctcgacgatttaatcaaaaggaacaaaagttccagcagtcggaaccccagaccaagaacatccggatctggatccggaaccggatccggaggccccagtccaaggcgtcgcttccctagccgtgccgccaaccgttccgctccatattcctccggaccggttcacgcaccggacagtacatgggaccacaacatgtttgcagaacatgccccggcgtatccagctgcccgtggagctggtgggatatcggggattgagaccggtatcaagctcctcatttcaaacttggattatggggtttcaaatgaagatatcaaggagcttttctcagaagctggtgatataaagcgttactcaattcattatgacaaaagtggaagatcaaagggaactgcggaagtaatcttttcacgtcgaagggatgcagaggcagctatcaagaaatataacaatgttcagctagatggaaagcccatgaaaattgagtttgcgggaccaaacattggtgctcctactcttcctccacttagaaatcgtctgtacagaaatccaaatcctgctccaagaagtcaacaaagaggtggtggatttagacgtcctcctcgaggtggtagagggagcatgagaaaggagggtggaaggggcagaggtcgcgttgagaacattactgcagaagatcttgatgccgacttggaaaagtatcatgcagaagccatgcagacaaactaa

SEQ ID NO: 500 - protein, 249 aa, Nicotiana benthamiana
MSNLDVSLDDLIKRNKSSSSRNPRPRTSGSGSGTGSGGPSPRRRFPSRAANRSAPYSSGPVHAPDSTWDHNMFAEHAPAYPAARGAGGISGIETGIKLLISNLDYGVSNEDIKELFSEAGDIKRYSIHYDKSGRSKGTAEVIFSRRRDAEAAIKKYNNVQLDGKPMKIEFAGPNIGAPTLPPLRNRLYRNPNPAPRSQQRGGGFRRPPRGGRGSMRKEGGRGRGRVENITAEDLDADLEKYHAEAMQTN

SEQ ID NO: 501 - DNA, 741 bp, Nicotiana benthamiana
atgtcaaatctcgatgtatccctcgacgatttaatcaaaaggaacaaaagttccagcagtcggaaccctagaccaagaacatccggatctggatccggatccggaggccccggtccaaggcgtcgccccaaccgtgccgccaaacgttccgctccatattcctccgggccggttcacgcaccggagagtacgtgggaccacgacatgtttgccgagcatgccccggcgtatccagctgcccgtggagccggtgggatatcggggattgagaccggtatcaagctcctcatttcaaacttggattatggggtttcaaatgaagatatcaaggagcttttctcagaagctggtgatataaagcgttactcaattcattatgacaaaagtggaagatcaaagggaactgcggaagtaatcttttcacgtcgaagggatgcagaggcagctatcaagaaatataacaatgttcagctagatggaaagcccatgaaaattgagtttgcaggaccaaacattggtgctcctgctcttcctccaattagaaatcgtctgtacagaaatccaaatcctgctccaagaagtcaacaaagaggtggtggatttagacgtcctcctcgaggtggtagagggagcatgagaaaggagggtggaaggggcagaggtcgcggtgagaacatttctgcagaagatcttgatgccgacttggaaaagtatcattcagaagcaatggagactaactga

SEQ ID NO: 502 - protein, 246 aa, Nicotiana benthamiana
MSNLDVSLDDLIKRNKSSSSRNPRPRTSGSGSGSGGPGPRRRPNRAAKRSAPYSSGPVHAPESTWDHDMFAEHAPAYPAARGAGGISGIETGIKLLISNLDYGVSNEDIKELFSEAGDIKRYSIHYDKSGRSKGTAEVIFSRRRDAEAAIKKYNNVQLDGKPMKIEFAGPNIGAPALPPIRNRLYRNPNPAPRSQQRGGGFRRPPRGGRGSMRKEGGRGRGRGENISAEDLDADLEKYHSEAMETN

SEQ ID NO: 503 - DNA, 1123 bp, Arabidopsis thaliana
ccgccgtcgaaagagaaacgtcgatcggagaacctttgaaatgtcgactggattagatatgtctctcgacgacatgatcgccaagaaccgtaagtctcgtggtggagccggccccgctcgtggaaccggatccggatccggaccgggtccgactcgccgcaacaaccctaatcggaaatcaacccgatctgctccataccaatcagcgccggagtccacctggggtcacgacatgttctccgatagatctgaagatcaccgatcgggacgttcctccgccggaatcgaaactggaaccaagctctacatttccaatttggattacggtgtcatgaacgaagacatcaaggaactgtttgctgaagttggagaacttaaacgctacacagttcattttgatagaagtggaagatcaaagggaactgctgaagtagtgtattctcggcgtggcgatgcactcgcagctgtgaagaagtataatgatgttcagctggatggaaaacccatgaagatagagattgtgggcactaatcttcaaactgctgcagccccgtctggtagacctgcgaatggaaactccaatggtgctccatggagaggaggacaagggagaggaggtcaacaacgaggtggtggacgaggaggcggtggccgaggtggtggtggtcgtggtaggcgtcctggtaagggccctgcagagaagatttctgcggaagatcttgatgcggatcttgataagtaccattctggagatatggagacaaactaaggaacgtgactgatcttctcaaaccggtaggggttttaggaggaagagaatcgagaaaatgtttgccagaggctttaccacttagcgcctttttggctgtgttgttcatttgtttcattagaatgactttacagaattgagaatatgtgttatttaaagttgttgtctatcttaataccctcaagtgaaaggcagaggaaggaataccaatttcgtttacagatcatatgcaggcaaaagagttttcagaaatcaggtttagttacttgtattgtgtctcttatccaagccatgccttgtggtattatgagcgcagaattttgattgaatattgttcatttgcattaaagtatc

SEQ ID NO: 504 - protein, 244 aa, Arabidopsis thaliana
MSTGLDMSLDDMIAKNRKSRGGAGPARGTGSGSGPGPTRRNNPNRKSTRSAPYQSAKAPESTWGHDMFSDRSEDHRSGRSSAGIETGTKLYISNLDYGVMNEDIKELFAEVGELKRYTVHFDRSGRSKGTAEVVYSRRGDALAAVKKYNDVQLDGKPMKIEIVGTNLQTAAAPSGRPANGNSNGAPWRGGQGRGGQQRGGGRGGGGRGGGGRGRRPGKGPAEKISAEDLDADLDKYHSGDMETN

SEQ ID NO: 505 - protein, 1629 aa, Glycine max
ATATCACCAGCCACCCTTCTCCCGTATCTCACTTCCTCGACGAAACCCTAAGCTTCCCCTTTCTTTCACTCTCATCAGATCCTTTCGTCGTTGCGCGAAACCCTATCTCTGAACCAGCAAACATGTCTGCAGCCATGGATATGTCGCTCGACGACATAATCAAGAACAACAAAAAGTCTGGATCCGGAAGTTCACGTGGCCGGACCCGACCCTCCGGATCCGGACCTACTCGCCGGCTCCCCAACCGTGCCGCCAACCGCGCCGCACCTTATGCCCCCGCTAAGGCGCCGGAGGCAACGTGGCAGCACGATTTATATGCAGATCAGCATGTGGCTGCGGCGGGGTACCCTGCTCAAGGTGGTCGTGCGGCTTCCATAGAAACTGGGACCAAGCTTTACATTTCAAACTTGGATTATGGTGTTTCCAATGATGATATTAAGGAATTGTTTGCTGAAGTGGGTGACTTGAAACGGCATGCGGTTCATTATGACAGGAGTGGCAGATCAAAGGGTACAGCAGAAGTAGTATTTTCACGACGAGCTGATGCTGTATCTGCTGTAAAGAGATACAACAACGTTCAATTAGATGGGAAACCAATGAAGATTGAAATTGTGGGAACAAACATTTCCACACCTGGTGTAGCTCCTGCTCCTAACGGAGCTATTGGAAATTTTAATGGAGTTCCTCGAAGTGGACAAGGAAGAGGTGGGGCATTAAGAAGGCCAGGAGGAAGAGGGCAAGGCATTCGAAGGGATCGGGGACGGGGAAGAGGTCGTGGTGGAGGAGGCCGTGGTGAAAAGGTATCTGCTGATGATCTTGATGCTGATTTGGAGAAGTATCATGCAGAGGCAATGCAATTGAACTGAAGGAATTGGCCATATTTTATTTTCTAGCTATTACATCTATGATTATTAGGAACTTGGTGATGGAACACCATGTGTTTATGTATCTTTTGCACTGGCCTACTTTTTAGGGAAAGGGAATGGATTTCCCAAGTTAAAACGTTTAGACTTGCCATATGGAGTTTGGGCTTATGTTGTCTATTATTGATTTTCCTTGGGTATGATATATGGATTACGAAACAGAAATCACCATGTAACATGAAGTCAAGCTTGCCTTCACTGGCATTAATTTGTTTTAACAAGTGGATTATGGAAGTGGGAACCATGATCACGTCTATCAATGTACAAAGAAATGTTTGGCTGCAAAATGTGGCAGGCTACAGAATTCACCCACAGCTGCTTTGTTGTTTTGGTTAAACCATACCAACACACTGGAATCTTCAAATAAGGTAGATTCCCTACCTCTTCTTTTAACACCCTCATCCCCGGAAAAGAGTCATGTGATCTCTGTTATTTTTATGACATTGTCATGTGCTAAACTAGTTTGATATAGTTTATTAAGGTTTGTTATCATGAGATGTTCGTACTTGTTTTAGGTGTGAACTTCTTTCCTGACTTTCTGGTAATTTTGGCTTATTATCTAGTGAGATGGAATCTATCATCTGTTCTATTTGACTTCATCGGCCGATTGCCCTGGTCAAGATACATGCCTACAGATGAAGATTGCACTCCTGGCTAATGATGCTATAGGAGTTAATATTTATAATACATTTGCGTGTCATGCTCA

SEQ ID NO: 506 - protein, 247 aa, Glycine max
MSAAMDMSLDDIIKNNKKSGSGSSRGRTRPSGSGPTRRLPNRAANRAAPYAPAKAPEATWQHDLYADQHVAAAGYPAQGGRAASIETGTKLYISNLDYGVSNDDIKELFAEVGDLKRHAVHYDRSGRSKGTAEVVFSRRADAVSAVKRYNNVQLDGKPMKIEIVGTNISTPGVAPAPNGAIGNFNGVPRSGQGRGGALRRPGGRGQGIRRDRGRGRGRGGGGRGEKVSADDLDADLEKYHAEAMQLN

SEQ ID NO: 507 - DNA, 1537 bp, Glycine max
gaatcccggtcgacgatttcgttgaattcatccttctgtgttctgtttctttccttttcttcttgggcgaaaccctaatctccccccttcacccttcgtacaccgcgtcgcatctacttccatcttctctcagatccaatctccgattcttgcttcactatcacaagcaaacatgtctgcggctttggatatgaccctcgaagatataattaagaacaacaagaaatcttccctcgccaacaccaggggccgaggccgagcctcgggacccggacccgctcgccgcctccccaaccgtgccgccaatcgcgccgcaccgtatgccgctgccaaggcgccggagacagcttggaaacacgatatgtacgcgaaccagccagtggccgcggcgtatccaggtggtcgagcgtcttccatcgaaacagggactaagctctacatttccaatttggattatggcgtttccaatgatgatattaaggagttgtttcttgaagttggcgacgtgaaacggcatactgttcattatgacaggagtgggagatccaagggtacggcagaagtagtcttctcgcgccgagctgatgctgtagctgcagtgaagaggtacaacaatgttcagctggatgggaaaccaatgaaggtagagattgtggggacgaacatcgctacacatgctgcaccacccgctgtgaatggaacttttggaaacccaactggagttcctagaagtggacaagggagaagtgggtcattaggaaggccacgtggtgggagtagaggtcgtggcagcattcaacggggccggggacgtggaagaggaagtcgtgatgaaaaggtatctgctgaagatcttgatgctgatttggagaagtatcatgctgaggctatgcaattaaactgaaggaaacaacgatgttctgttttattgctattacatttgcggttgttagggccatgttgatggaacaccgccgaattatgtatctttatcacagtcgtgcttttcggaaaggaaaaggataacttagagtgaaaacttttacagttgatatatgtagtttgggattctgttatgaaatatttgttttcgttgggtatgactatgaaatgtggctgaagaaaccgaagtctgcttgtattatgcactccggcttcctttcattggatttaatcatttgtttattcaagtattcaacaagtgggtttggaagtgggaaccatgatctcatctatgcatgcacacaacacaaagaaagcatgggctgcattgtaggaggctgcagaattcacccattgttgctttgtgctttggttaaaactattaaagtggaatcttcaaataagtgcactggtcaagctaagaagtcaacagatgaagagcctccaggataaaggatgctgcaggagttagtatttatgttatgctcactctggttgcattcagattaagttgcccctgttttgaattctgtttgcttttcacctattctttgatctgcaattctcggaattgtcgtcggttgaagttaaagtg

SEQ ID NO: 508 - protein, 243 aa, Glycine max
MSAALDMTLEDIIKNNKKSSLANTRGRGRASGPGPARRLPNRAANRAAPYAAAKAPETAWKHDMYANQPVAAAYPGGRASSIETGTKLYISNLDYGVSNDDIKELFLEVGDVKRHTVHYDRSGRSKGTAEVVFSRRADAVAAVKRYNNVQLDGKPMKVEIVGTNIATHAAPPAVNGTFGNPTGVPRSGQGRSGSLGRPRGGSRGRGSIQRGRGRGRGSRDEKVSAEDLDADLEKYHAEAMQLN

SEQ ID NO: 509 - DNA, 851 bp, Hordeum vulgare
  misc_feature (320)..(320): n is a, c, g, or t
  misc_feature (673)..(673): n is a, c, g, or t
  misc_feature (759)..(760): n is a, c, g, or t
  misc_feature (798)..(798): n is a, c, g, or t
cccgcggccgcgcgcgcgaagccatggcggagaccatcgacatgtcgctcgacgacatcatcaagaacaacaagaagggcaactcctcctccggcgggggcggccgccgcctcgagggccgccgtggatctgccgctggcggcagcggcgcggcctccggcgggggcgctgtcggaggcgtcggccccaacaggcgcgccttcaagaggtcggggaacagggcggcgccctaccagccgccgaaggccccggaatcggcgtggcagcacgacatgtactcggacgcctctgccaaaggcggcggccgccggagggtctcngctatcgggaccggcgccaagctctttattaccaatgtggacttcggcgtctcgaccgaggacctccaggagccttttcttccaggctggggggatctgaagcgatgctcgattaactttgaccgaaatgggcggggctaagggaccgctggaagttttttgcaagggggggtaggctggtgcagcgaaaaagaagaaaaaaagacaactggaggaagctagaaaaagaaaacttggactacacctctacgttccggtgactacaacaaaaaggagactggcggaaggggcaaaagggacaggggggggtaactagttacacaaaaaacgccgcgcagggggggagaggccanaggaaccgggagggaggagaggttgggggagggtgggaaaagaggaggacgaaggacgcgaagagagagagtgagggagagacacnnacgcgggggcggcgcaggaaacaagagaagagagttgnggatggaggagggagacatggaaagggagagctgacgcgggtggtggggtcaa

SEQ ID NO: 510 - protein, 145 aa, Hordeum vulgare
MAETIDMSLDDIIKNNKKGNSSSGGGGRRLEGRRGSAAGGSGAASGGGAVGGVGPNRRAFKRSGNRAAPYQPPKAPESAWQHDMYSDASAKGGGRRRVSAIGTGAKLFITNVDFGVSTEDLQEPFLPGWGDLKRCSINFDRNGRG

SEQ ID NO: 511 - DNA, 2046 bp, Hordeum vulgare
  misc_feature (1878)..(1878): n is a, c, g, or t
atctcccaaattccccaacaccccacgacttggcaaccctattcaacttccccatcaattcgattccccatcgccgagctcccccctcccaaccctagcgccagatccgcccgcccccgcgcgcgcgaagccatggcggagaccatcgacatgtcgctcgacgacatcatcaagaacaacaagaagggcaactcctcctccggcgggggcggccgccgccgcgagggccgccgtggatctgccgctggcggcagcggcgcggcctccgccgcctccgctgtcggaggcgtcggccccaacaggcgcgccttcaagaggtcggggaacagggcggcgccctaccagccgccgaaggccccggaatcggcgtggcagcacgacatgtactcggacgcctctgccagaggcggcggcggcgggagggtctcggctatcgagaccggcaccaagctcttcatcaccaatttggacttcggcgtctcgaccgaggacctcaaggagcttttctccgagctgggtgatctgaagcgatgctcgattaactttgaccgaagtgggcggtctaagggaacagctgaagttatatttgcaaggcgtggtgatgctgttgcagcgataaagaaatataacaatgtccaacttgatggcaagcctatgaaaatagagatacttgggactaacactcctacagctccagctgcactaccaaccaataatggaagctatgctaggaatgttgctaagagtgcaccaaggggtgtctcagctagtttgccacagaacaggccccgtgcaaggggtgggaggggtcgtggtggtggcggcggcggaggcagtggatctggcggtcgtcgtgggaaagagcgtagtcagccaaggtctgctgaagaacttgatgctgagttggagaagtaccatgcccagggtgcggcgccgatgcagaccaacgaataagtcgacatctttgcagtgttgatattttcaacatgaaatttgaaggatgcccctacgttcctgctttttgtgctactatgttcaagggacaacaaaaccttttacttgtcaggttcttggcttactgaattgtatgggttatgtgtctacatagaactagagttgagtggataccagtgaacactactgttatgaacattacttgattgcctttagtttctgccttccttgaggaacgcaaggactaaggaccacccaagttgctccgcatgtgaaagttattgaagatgtatgaggtgctcacattcctttgctacccgtctatcatgaggctgaaaatcagatgtgccatggtgatcaagttaaacccttatcttgggtggtctttgggcgttgtttccctgctgaacgagctttttaagcttcagccatctttagtaagaggtggttgctaatcttatgttattattatgctagcattgcttttgatgtagcaatattctcttgcccataccgagccacatgccagctggagagcgtgttcttttagaagttcatgtgatctttcttcgtcaggtgctcaacaagttgcctgtggctgtggtagttgtgcttcttcctgaagaagcatcaaggtgcaaatctagcaatactcttgcacatacgagtcacatgccagctggagggatggatactgttctttcgtgtgatcttccttcttcaggtggtccacaaagtgcctggtatgattttggtggcttgctagctgtgcttcttactgaagaagcattaaggtgcaaatcttgctttgcgatctgctttacagttaagggttgtctattggtttgatggtacacatagattttgccatcttttggatgcccttttgccccccttgcagccgctgacttcatttatggtggnttggtgggccatttctgtttgaaattcaactaggcggcaaagtattatttggaacccacctaatctggccgatctattcaactatatctttgttccttgctggggattagaatcatatggctgacttgtttcaacctgtccaattttgctgttggattgatgaataat

SEQ ID NO: 512 - protein, 273 aa, Hordeum vulgare
MAETIDMSLDDIIKNNKKGNSSSGGGGRRREGRRGSAAGGSGAASAASAVGGVGPNRRAFKRSGNRAAPYQPPKAPESAWQHDMYSDASARGGGGGRVSAIETGTKLFITNLDFGVSTEDLKELFSELGDLKRCSINFDRSGRSKGTAEVIFARRGDAVAAIKKYNNVQLDGKPMKIEILGTNTPTAPAALPTNNGSYARNVAKSAPRGVSASLPQNRPRARGGRGRGGGGGGGSGSGGRRGKERSQPRSAEELDAELEKYHAQGAAPMQTNE

SEQ ID NO: 513 - DNA, 795 bp, Medicago truncatula
cttcacaacccctcgacgaaaccctaactttttcacgatccttcttcttcctcttcctccctctcgttgaactctcaaaatcacaaccatgtctgcagcactcgatatgaccctcgacgacatcattaagaacaacaaaaaatccggatccggtaaccctagaggaggccgttccagacccggacccgcttccggacctggacccgctcgccgtattcttaatcgcgccggtaaccgcgccgcaccttactccgccgctaaggcgccggagacgacgtggcagcatgatttgtatgcagatcagcatgtagctgcggcggcgtatccagcagctcaaggtggtcgtgctccttctattgaaactggaaccaagctctatatttctaatttggattatggtgtttccaatgatgatattaaggagttgttttctgaagttggtgacttgaaacggcacggcgttcattatgacaggagtggcagatcgaagggtaccgcagaagtagtcttctcacggagacaagatgctgtagctgctgtgaagagatacaacaatgttcaactagatgggaaaccaatgaagatagagattgttggaaccaacatttctacacctggtgcggctcctgttgtaaatgcacccattggaaattttaatggaattcctcaaagtgggcaaggcagagttggagaatttcgagggccgggaggaagaggtcaaggcattcgaagaaatcgagacgtggaagagttagcggtggacccccctgtgggtgtcctgtttgaaggtcctgg

SEQ ID NO: 514 - protein, 236 aa, Medicago truncatula
MSAALDMTLDDIIKNNKKSGSGNPRGGRSRPGPASGPGPARRILNRAGNRAAPYSAAKAPETTWQHDLYADQHVAAAAYPAAQGGRAPSIETGTKLYISNLDYGVSNDDIKELFSEVGDLKRHGVHYDRSGRSKGTAEVVFSRRQDAVAAVKRYNNVQLDGKPMKIEIVGTNISTPGAAPVVNAPIGNFNGIPQSGQGRVGEFRGPGGRGQGIRRNRDVEELAVDPPVGVLFEGPG

SEQ ID NO: 515 - DNA, 1244 bp, Medicago truncatula
ttctcttcttctctctcacaaaaaaaacttcacaacccctcgacgaaaccctaactttttcacgatccttcttcttcctcttcctccctctcgttgaactctcaaaatcacaaccatgtctgcagcactcgatatgaccctcgacgacatcattaagaacaacaaaaaatccggatccggtaaccctagaggaggccgttccagacccggacccgcttccggacctggacccgctcgccgtattcttaatcgcgccggtaaccgcgccgcaccttactccgccgctaaggcgccggagacgacgtggcagcatgatttgtatgcagatcagcatgtagctgcggcggcgtatccagcagctcaaggtggtcgtgctccttctattgaaactggaaccaagctctatatttctaatttggattatggtgtttccaatgatgatattaaggagttgttttctgaagttggtgacttgaaacggcacggcgttcattatgacaggagtggcagatcgaagggtaccgcagaagtagtcttctcacggagacaagatgctgtagctgctgtgaagagatacaacaatgttcaactagatgggaaaccaatgaagatagagattgttggaaccaacatttctacacctggtgcggctcctgttgtaaatgcacccattggaaattttaatggaattcctcaaagtgggcaaggcagagttggagaatttcgagggccgggaggaagaggtcaaggcattcgaagaaatcgaggacgtggaagaggtagcggtggaccccgtggtggtggtcgtggtggaggtcgtggtagaggccgtgatgataaagtatctgcagaagatcttgatgctgagctggagaagtatcatgctgaggccatgcaattaaactgaaggagttatcttagttctgttttcttcttgcttttacatctatggttattaggtgcgcattgtgatggatgaccacatatgtttatgtatttggagccctatgttttagggaagggaaaaaacttgagtgaaaactgttgcttgatatggagtttgggcttctgttgtctaaaatattcgtattccttgggaatgtatgaactttgagttatcagaagtcagcttgtaatgtgcatgcactctaggttactttcattgacgttattaatttgttttatcaacagtggattaatgaaggtgggaggtggggaacatgctctcatctatcaatgcacag

SEQ ID NO: 516 - protein, 263 aa, Medicago truncatula
MSAALDMTLDDIIKNNKKSGSGNPRGGRSRPGPASGPGPARRILNRAGNRAAPYSAAKAPETTWQHDLYADQHVAAAAYPAAQGGRAPSIETGTKLYISNLDYGVSNDDIKELFSEVGDLKRHGVHYDRSGRSKGTAEVVFSRRQDAVAAVKRYNNVQLDGKPMKIEIVGTNISTPGAAPVVNAPIGNFNGIPQSGQGRVGEFRGPGGRGQGIRRNRGRGRGSGGPRGGGRGGGRGRGRDDKVSAEDLDAELEKYHAEAMQLN

SEQ ID NO: 517 - DNA, 759 bp, Nicotiana benthamiana
atggctgaggcagctttggatatgagtttagacgatctcatcaagaagaataaaaccgataccggaggtaaacgtcgcggcagaggtcgtggcggcgcctccggtcctggtcctgctcgtcgattccccaatcgctcggctaaccgagctgcaccttattccaccgccaaggctcctgaggcggcgtggaatcatgatatgttcgctgcggcagatcaagctttcccttttggacaagccggaggcgatcaggctgcgtcttccatatcgactgggacaaagctctacatctccaatctcgattatggcgtctccaatgaggatatcaaggagctcttctcagaagctggtgacctgaaacgctatgctatacattatgataggagcggaagatcaaagggaacggcagaggtggtcttctcacgtagacaagatgcactagctgcagttaagaggtacaacaacgttcagcttgatgggaagccgatgaagattgaaattgttgggaccaacattgccactcctgctgcccctgctttcaatggtgcttttggttttggagacactaatggaggtcccagaactgatcaagcaagaagtggtggcttcgggaggtcacggggtggtagagggcgcggtcgcggatttcggggaggcagcagaggacggggaagaggtgatcgtggagagaaggtatctgcagaagatctagatgctgatctgatgaagtatcatacagaagcaatgcaaacgaactga

SEQ ID NO: 518 - protein, 252 aa, Nicotiana benthamiana
MAEAALDMSLDDLIKKNKTDTGGKRRGRGRGGASGPGPARRFPNRSANRAAPYSTAKAPEAAWNHDMFAAADQAFPFGQAGGDQAASSISTGTKLYISNLDYGVSNEDIKELFSEAGDLKRYAIHYDRSGRSKGTAEVVFSRRQDALAAVKRYNNVQLDGKPMKIEIVGTNIATPAAPAFNGAFGFGDTNGGPRTDQARSGGFGRSRGGRGRGRGFRGGSRGRGRGDRGEKVSAEDLDADLMKYHTEAMQTN

SEQ ID NO: 519 - DNA, 1179 bp, Oryza sativa
aaaaaatctcccaattccccaaccctaacgccgctctcgcctccaccccccaaatcccgaatccgccgcctcttcgttcgtcgtcgagctcgctcgctcgcccaaccctagcgcgccagatctacccgcccccgagcagccgccatggcggagaccctcgacatgacgctcgacgacatcatcaagaacaacaagaaggccaacccctcgtccggccgcggccgccgcggatctgccgctggcggcggcggcggcgggggtgggggtgttggtggtggcggcggcggcggcgtggggccgacgaggcggcccttcaagaggtcggggaacagggcggggccctaccagccgcccaaggcccctgaatcggcgtggcagcacgacatgtactcggatgtcgcggcaggcggcggcggcggcagcggcggaggcgggagggtctcggctatcgagactggcaccaagctctacatctccaatttggacttcggcgtctcgaccgaggatatcaaggagcttttctctgaattaggtgatcttaagaaatacgtaattcactatgacagaagtgggaggtctaagggaacagctgaagttgtatttgcaaggcgtggcgatgctgtcgcagcagtgaagaaatataacaatgtgcaacttgatggtaagccaatgaaaatagagattcttgggaccaatactcctacagctgcagctgctcttccagcaaataacggaggctacgttagaaatgttgctaagagtgcaccaaggggtggcccagctggactaccgcagggtagacctcgtccaagggggggtgggaggcgccgtggtggcggaggaggcagtggtggtcctggtggatccggtggtcgccgtggcaaagagcgtagccagccaaagtctgctgaagaacttgatgctgacttggagaaataccatgcagatgcgatgcagaccaactagatcttcacggtgttgatatttcaacatgaaatctgaaggatgtttatctgcttgttcctgctatttgtgctaccatgttcagtggcaacaacaaaacctttgtttgtcgggtcttggtttactgaattgtacggttttatgtgtctacatagaactagagttaagtggatgctggtgaacactgttatgaatattacttggttgccacttatg

SEQ ID NO: 520 - protein, 273 aa, Oryza sativa
MAETLDMTLDDIIKNNKKANPSSGRGRRGSAAGGGGGGGGGVGGGGGGGVGPTRRPFKRSGNRAGPYQPPKAPESAWQHDMYSDVAAGGGGGSGGGGRVSAIETGTKLYISNLDFGVSTEDIKELFSELGDLKKYVIHYDRSGRSKGTAEVVFARRGDAVAAVKKYNNVQLDGKPMKIEILGTNTPTAAAALPANNGGYVRNVAKSAPRGGPAGLPQGRPRPRGGGRRRGGGGGSGGPGGSGGRRGKERSQPKSAEELDADLEKYHADAMQTN

SEQ ID NO: 521 - DNA, 848 bp, Populus trichocarpa
caagagagagagagaaaggtaattgaaaaaatgacgacaacggccctggacatgtctctagacgacataatagaaaacaacaggaagtcgtcgaattctcgaggcagacctcgttcttctggcggccctggtccttcccgtcggttctccaatcgcgcgggaaacataacaacgccctattccaagccccaggtccaagctccagagacgtcatggcagcacgacatgttcacggataatcctgtttctgcttctgcatatcctgctcgtgcttcttccattgagactgggactaaactctatatttccaacttagatttcggtgtttctactgaagacatcaaggagcttttctcggagattggtgaccttaaacgatattcagtccattatgataggagtggaagatcagagggaacggcggagatagtctttgcacggcgggaagatgctgtctctgctgtcaagagatacaataatgttcaactggatggaaagccaatgaagattgagattgtgggaacaaatattgccactcggcctgctgtccctccatccactaatggcatgtataggaatcaaaatattgctgctcctagaagtagtagccaaggaaggggtggtaccacgggacggcctcggggtggtgggcatggagttagaaggggtggtcgtggaaggggtagaggtcgtggtgaaaagatatctgcagaagatctagatgctgatttagaaaagtaccattcagaagctatgcaagaaaactgatggcattgccaagttcttgctcattttgctcgtttaagttttttcctggaatagcaccttgcattatgatgcttcgaatt

SEQ ID NO: 522 - protein, 245 aa, Populus trichocarpa
MTTTALDMSLDDIIENNRKSSNSRGRPRSSGGPGPSRRFSNRAGNITTPYSKPQVQAPETSWQHDMFTDNPVSASAYPARASSIETGTKLYISNLDFGVSTEDIKELFSEIGDLKRYSVHYDRSGRSEGTAEIVFARREDAVSAVKRYNNVQLDGKPMKIEIVGTNIATRPAVPPSTNGMYRNQNIAAPRSSSQGRGGTTGRPRGGGHGVRRGGRGRGRGRGEKISAEDLDADLEKYHSEAMQEN

SEQ ID NO: 523 - DNA, 656 bp, Populus trichocarpa
attctaagttaaaacaaagaaaaaagcaacatgtcaagcgctttggatatgtccctcgacgatatcatcaaaaatagcaaaaaacccggatccgctaacttccggggccgtggtcgaggccacccttccggagccggtcctgctcgccgcttccctaaccgcgccgccaatcgttcagctccttataccgccgctaaggctccggaaagcacgtggcaacacgacatgttcagggatcaatcaggtcggacctcctctttagaaggagcaaagctctatgtttccaatttagattatggagtctctaacgaggacatcaaggaattgtttttggaagtgggtgaactgaaaaggtattcgatccattacgatcggagtggcagatcgaagggaacggcagaagttgtcttcgcacgacaagctgaagctgtggctgctgttaagagatacaacaatgttcagcttgatgggaaaccgatgaagatagagattgtgggaacaaattttgttgctcctcctgcgcctccggctgctaatgctgcttttggaaattctaatggagtttctggacggtaatatctcccctcctactctggtctttgtcgcttgtctactgtaaattcctaattatggtttgtaaaagagcaaaattctga

SEQ ID NO: 524 - protein, 181 aa, Populus trichocarpa
MSSALDMSLDDIIKNSKKPGSANFRGRGRGHPSGAGPARRFPNRAANRSAPYTAAKAPESTWQHDMFRDQSGRTSSLEGAKLYVSNLDYGVSNEDIKELFLEVGELKRYSIHYDRSGRSKGTAEVVFARQAEAVAAVKRYNNVQLDGKPMKIEIVGTNFVAPPAPPAANAAFGNSNGVSGR

SEQ ID NO: 525 - DNA, 439 bp, Solanum lycopersicum
tatgactctaacaaatggctggcgctgctcatgatatgactctcgacgatctcatcaagaagaataagaccggtaccggaggtaagcctcgtggcagaggccgcggcgccgcctccacctccagtgctggaccttctcaactggtccctaatcgttctgctaaccgagctgcaccttattccatcgccaaggcccctcaagcgtcgtggaatcatgatatgttcgaggcagatcaagccgtcgcctttggtcaagctggtggtcgggcgtcttccatagagactgggactaaactctacatctccaatcttgattacggcgtctccaatgaggatatcaaggagctcttttcagaaattggtgacctgaaacgttatgctgttcattatgataggagcgggagatcaaagggaacagcagaggtggttttctcacgtag

SEQ ID NO: 526 - protein, 142 aa, Solanum lycopersicum
  misc_feature (142)..(142): Xaa can be any naturally occurring amino acid
MAGAAHDMTLDDLIKKNKTGTGGKPRGRGRGAASTSSAGPSQLVPNRSANRAAPYSIAKAPQASWNHDMFEADQAVAFGQAGGRASSIETGTKLYISNLDYGVSNEDIKELFSEIGDLKRYAVHYDRSGRSKGTAEVVFSRX

SEQ ID NO: 527 - DNA, 1124 bp, Solanum lycopersicum
tgaaattatttgataagtaattgagtattaaatacgagcgagcttcttttctcaaagttcaaaccctacccagctttctacccacaaacaaagacgcaattacaaatggctgaggcagctttggatatgactctcgacgatctcatcaagaagaataagaccggtaccggaggtaagcctcgtggcagaggccgcggcgccgcctccacctccagtgctggaccttctcgacgggtccctaatcgttctgctaaccgagctgcaccttattccatcgccaaggcccctcaagcgtcgtggaatcatgatatgttcgaggcagatcaagccgtcgcctttggtcaagctggtggtcgggcgtcttccatagagactgggactaaactctacatctccaatcttgattacggcgtctccaatgaggatatcaaggagctcttttcagaaattggtgacctgaaacgttatgctgttcattatgataggagcgggagatcaaagggaacagcagaggtggttttctcacgtagacaagatgcactagctggtgttaaaaggttcaacaatgttcagcttgatgggaagccaatgaagattgaaattgttggaaccaacattgtcactcctactgcccctttttccaatggagcttttggttttggagatactaatggagctcctagaagtggtcaagtaagaggtggtggttttgggaggtcacggggtggcaaaggacgtgatcgtggatttcgaggaggcaacagaggatggggaagaggaggtcgtggagaaaaggtatctgcagaagatctagatgctgatttgatgaaatatcatacagaagcaatgcaaacgaactgatgggtctggtagtaatgtttgcctctacatccagtgcttagtggagccacaccacaactacaccacaccacacacagactctctgtactttggccttgtcttttcaagttgcaagaaagaagtacttgttggaaaatttcagccgttcctgtatgggtattatgcttatttaatttttcccttgctttggatttgtgacttggatggagtgatgaaatctactcaactctttaatttatgtaagagatgtatgattatagtgg

SEQ ID NO: 528 - protein, 251 aa, Solanum lycopersicum
MAEAALDMTLDDLIKKNKTGTGGKPRGRGRGAASTSSAGPSRRVPNRSANRAAPYSIAKAPQASWNHDMFEADQAVAFGQAGGRASSIETGTKLYISNLDYGVSNEDIKELFSEIGDLKRYAVHYDRSGRSKGTAEVVFSRRQDALAGVKRFNNVQLDGKPMKIEIVGTNIVTPTAPFSNGAFGFGDTNGAPRSGQVRGGGFGRSRGGKGRDRGFRGGNRGWGRGGRGEKVSAEDLDADLMKYHTEAMQTN

SEQ ID NO: 529 - DNA, 919 bp, Triticum aestivum
tttttttgagcacctcatacatcttcaataactttcacatgcggagcaacttgggtggtccttagtccttgcgctcctcaaggaaggcagaaactaaaggcaatcaagtaatgttcataacagtagtgttcaccggtatccactcaactctagttctatgtagacacataacccatacaattcagtaagccaagaacctgacaagtaaaaggttttgttgtcccttgaacatatagtagcacaaaaagcgggaacaaaggggcacccttcaaatttcatgttgaatatcaacgctgcaaagatgtcgatttattcggtggtctgcatcggcgtcgtaccctgtgcatggtacttctccaactcagcatcaagttcttcagcagaccttggctggctacgctctttcccacgacgaccgccagatccactgcctccgccaccaccacgacgacccctcccaccccttgcacggggtctgttctgtggcaaactagctgagacaccccttggtgcactcttagcaacattcctagcataggttccattattggttggtagtgcagctggagcagtaggagtgttagtcccaagtatctctattttcataggcttgccatcaagttggacattgttgtatttcctcagcgctgcaacagcatcaccacgccttgcaaatataacctcagctgttcccttagacctcccacttcggtcatagtgaatcaagcatcgcttcacatcacccagctcggagaaaagctccttgaggtcctcggttgagacgccgaagtccaaattggtgatgaggagcttggtgccggtctcgatagcagagaccctcccgccgccgccgcctctggcagaggcgtcagagtacatgtcgtgctgccacgccgattccggcggcacgagctcgtgc

SEQ ID NO: 530 - protein, 189 aa, Triticum aestivum
MYSDASARGGGGGRVSAIETGTKLLITNLDFGVSTEDLKELFSELGDVKRCLIHYDRSGRSKGTAEVIFARRGDAVAALRKYNNVQLDGKPMKIEILGTNTPTAPAALPTNNGTYARNVAKSAPRGVSASLPQNRPRARGGRGRRGGGGGSGSGGRRGKERSQPRSAEELDAELEKYHAQGTTPMQTTE

SEQ ID NO: 531 - DNA, 698 bp, Triticum aestivum
  misc_feature (643)..(643): n is a, c, g, or t
cacgacttggcaaccctaatcagcttcccccaccaattctcgattccccgtcgccgagctccccctcccaaccctagcgccagatccgctcgctcgcccgcgcagccatggcggagtccctcgacatgtccctcgaggacatcatcaagagcaacaagaagggcaactcctcgtccggcgggggtggccgccgccgcgagggccgccttggatctgccgccgccggcagcggcgcggccgcggccgccgccggaggcgtccgccccaacaggcgcgccttcaagaggtcggggaacagggcggcgccctaccagccgccgaaggccccggaatcggcgtggcagcacgacatgtactctgacgcctctgccagaggcggcggcggcgggagggtctctgctatcgagaccggcaccaagctcctcatcaccaatttggacttcggcgtctcaaccgaggacctcaaggagcttttctccgagctgggtgatgtgaagcgatgcttgattcactatgaccgaagtgggaggtctaagggaacagctgaggttatatttgcaaggcgtggtgatgctgttgcagcgctgaggaaatacaacaatgtccaacttgatggcaagcctatgaaaatagagatacttgngactaacactcctactgctccagctgcactaccaaccaataatggaacctatgct

SEQ ID NO: 532 - protein, 197 aa, Triticum aestivum
  misc_feature (179)..(179): Xaa can be any naturally occurring amino acid
MAESLDMSLEDIIKSNKKGNSSSGGGGRRREGRLGSAAAGSGAAAAAAGGVRPNRRAFKRSGNRAAPYQPPKAPESAWQHDMYSDASARGGGGGRVSAIETGTKLLITNLDFGVSTEDLKELFSELGDVKRCLIHYDRSGRSKGTAEVIFARRGDAVAALRKYNNVQLDGKPMKIEILXTNTPTAPAALPTNNGTYA

SEQ ID NO: 533 - DNA, 2113 bp, Triticum aestivum
  misc_feature (1310)..(1310): n is a, c, g, or t
tcggcacgaggcgacttggcaaccctaatcagcttccccaaccaattcgattccccgtcgccgagctccccctcccaaccctagcgccagatccgcccgctcgcccgcgcagccatggcggagtccctcgacatgtccctcgaggacatcatcaagagcaacaagaagggcaactcctcgtccggcgggggtggccgccgccgcgagggtcgccgcggatctgccgccgccgccggaggcgtcggccccaacaggcgcgccttcaagaggtcggggaacagggcggcgccctaccagccgccgaaggccccggaatcggcgtggcagcacgacatgtactcggacgcctctgccagaggcggcggcggcgggagggtctcggctatcgagaccggcaccaagctcctcatcaccaatttggacttcggcgtctcaaccgaggacctcaaggagcttttctccgagctgggtgatgtgaagcgatgcttgattcactatgaccgaagtgggaggtctaagggaacagctgaggttatatttgcaaggcgtggtgatgctgttgcagcgctgaggaaatacaacaatgtccaacttgatggcaagcctatgaaaatagagatacttgggactaacactcctactgctccagctgcactaccaaccaataatggaacctatgctaggaatgttgctaagagtgcaccaaggggtgtctcagctagtttgccacagaacagaccccgtgcaaggggtgggaggggtcgtcgtggtggtggcggaggcagtggatctggcggtcgtcgtgggaaagagcgtagtcagccaaggtctgctgaagaacttgatgctgagttggagaagtaccatgcacagggtacgacgccgatgcagaccaccgaataaatcgacatctttgcagcgttgatatttcaacatgaaatttgaagggcgcccctttgttcccgctttttgtgctactatatgttcaagggacaacaaaaccttttacttgtcaggttcttggcttactgaattgtatgggttatgtgtctacatagaactagagttgagtggataccggtgaacactactgttatgaacattacttgattgcctttagtttctgccttccttgaggagcgcaaggactaaggaccacccaagttgctccgcatgtgaaagttattgaagatgtatgaggtgctcacattcctttgccgccaatctatcatgaggctgaaattcagatgtgccatggtgatcaagctaaacccttattttgggtggtctttgggcgttgtttccccgcngaacgatcttttaagcttcagccatctttagtaagaggtggttgcatactcttatgctattattatgctagcattgctttattctcttgcccatagcaaaaccacatgccagctggagacgttgtgtgatcttccttccccaggtgcttaacaagttacctggtatggttattgtggctttgctaattgtgcttcttcataagcaaggtgcaaatctagcaatattctcttcacgtaccgagtcacatgccagctggaggggtactgttcttttagaagttttgcgtgatcttccttcttcaggggtcaacaaagtgtctgatatgagtatggtggattcgctagttgggcttcttactgaagaagcattaaggtgcaaatcttgctttgcgatctgctaacagttaagggttgccaattggtttggtggtgcacagatttcccattcgttggacgcccctttggcgcccccttgcagctgctgacttcatttatgatggttgggcctttctgtttgaaattcaactaggcatcaaagtactatttggaacccaactaatctggctgatctattcaactatatctttattccttgctggggatctgaagcgtaggttcgaattttgctgttgggttgcatgattgcagatgaatgatggcttgcagttggccaatcagcttaagagtttttggtggcatgataaacggcatgataaaccaccgaagtactgagttgctttttttctgttgttttagtattgttttgttgctgctgctattgttggaactgccatatagattgt

SEQ ID NO: 534 - protein, 262 aa, Triticum aestivum
MAESLDMSLEDIIKSNKKGNSSSGGGGRRREGRRGSAAAAGGVGPNRRAFKRSGNRAAPYQPPKAPESAWQHDMYSDASARGGGGGRVSAIETGTKLLITNLDFGVSTEDLKELFSELGDVKRCLIHYDRSGRSKGTAEVIFARRGDAVAALRKYNNVQLDGKPMKIEILGTNTPTAPAALPTNNGTYARNVAKSAPRGVSASLPQNRPRARGGRGRRGGGGGSGSGGRRGKERSQPRSAEELDAELEKYHAQGTTPMQTTE

SEQ ID NO: 535 - DNA, 945 bp, Zea mays
caattcctcaccctaccccctcgctgctttctcctccccgtcgacctcgccaatcttcctcccgctaaccctagtccagcacccgagatctactccgcgcaaacagccatggcggagacgctcgacatgaccctcgacgacatcatcaagaacaacaagaagagtaacccctcgtctcgcggggcccgccgcagccgcggcgtatccgcccctggcggcgggaccggcggggtcgggccgaccaggcgcccctttaaaagggctgggaacaggcaggcgccctaccagccgccgaaggcccccgacgctgcgtggcagcacgacatgtaccctgcggtcgccgcaggaggcggcggcggcggcgggagggtctcggctctcgagacgggcgccaagctctacatctccaacctggactttggggtttcgaacgaggatattaaggagcttttctctgagctaggtgatttgaagcgtttttcgataaattatgatcgaagtgggaggtctaagggaacagctgaagttgtatttgcaaggcgttctgatgctgtagcggcggttaagaaatatgacaatgtccaacttgatggtaagcccatgaagatagagatagttggtaccaatactccagctgcagcagctgctcatccagtccctaatggtggtcatgctaggaatgctgcgaggagtgcaccaaaggatgctgctccagcaggtatgtcgcagcatagaacccatcagaggggtgggaggcgtgctgctggatctggtggtggtcgtcgtggcaaagagcgcagcaagccaaagtcgactgaagaactcgatgctgatttggagaagtatcatgctgatgcgatgcagaccaactaaatacattcacaaatttgatattcgacatcaaatatcaagcgcattagtcctcccatacagctgtttgtgcta

SEQ ID NO: 536 - protein, 254 aa, Zea mays
MAETLDMTLDDIIKNNKKSNPSSRGARRSRGVSAPGGGTGGVGPTRRPFKRAGNRQAPYQPPKAPDAAWQHDMYPAVAAGGGGGGGRVSALETGAKLYISNLDFGVSNEDIKELFSELGDLKRFSINYDRSGRSKGTAEVVFARRSDAVAAVKKYDNVQLDGKPMKIEIVGTNTPAAAAAHPVPNGGHARNAARSAPKDAAPAGMSQHRTHQRGGRRAAGSGGGRRGKERSKPKSTEELDADLEKYHADAMQTN

SEQ ID NO: 537 - DNA, 1085 bp, Zea mays
gcacgaggcctttcccagccaaaagaaatatccaattcctcaccctaccccctcgctgctttctcctccccgtcgacctcgccaatcttcctcccgctaaccctagtccagcacccgagatctactccgcgcaaacagccatggcggagacgctcgacatgaccctcgacgacatcatcaagaacaacaagaagagtaacccctcgtctcgcggggcccgccgcagccgcggcgtatccgcccctggcggcgggaccggcggggtcgggccgaccaggcgcccctttaaaagggctgggaacaggcaggcgccctaccagccgccgaaggcccccgacgctgcgtggcagcacgacatgtaccctgcggtcgccgcaggaggcggcggcggcggcgggagggtctcggctctcgagacgggcgccaagctctacatctccaacctggactttggggtttcgaacgaggatattaaggagcttttctctgagctaggtgatttgaagcgtttttcgataaattatgatcgaagtgggaggtctaagggaacagctgaagttgtatttgcaaggcgttctgatgctgtagcggcggttaagaaatatgacaatgtccaacttgatggtaagcccatgaagatagagatagttggtaccaatactccagctgcagcatctgctcatccagtccctaatggtggtcatgctaggaatgctgcgaggagtgcaccaaaggatgctgctccagcaggtatgtcgcagcatagaacccatcagaggggtgggaggcgtgctgctggatctggtggtggtcgtcgtggcaaagagcgcagaagccaaagtcgactgaagaactcgatgctgatttggagaagtatcatgctgatgcgatgcagaccaactaaatacattcacaaatttgatattcgacatcaaatatcaagcgcattagtccttccattacagctgtatgtgctaccatgttcaggggacaacaaaccttttctttgttgggggcgggggtattgctttactgagtattgtggattttatgtgtatacaatagagctagagttgggtgatgct

SEQ ID NO: 538 - protein, 315 aa, Zea mays
MAETLDMTLDDIIKNNKKSNPSSRGARRSRGVSAPGGGTGGVGPTRRPFKRAGNRQAPYQPPKAPDAAWQHDMYPAVAAGGGGGGGRVSALETGAKLYISNLDFGVSNEDIKELFSELGDLKRFSINYDRSGRSKGTAEVVFARRSDAVAAVKKYDNVQLDGKPMKIEIVGTNTPAAASAHPVPNGGHARNAARSAPKDAAPAGMSQHRTHQRGGRRAAGSGGGRRGKERRSQSRLKNSMLIWRSIMLMRCRPTKYIHKFDIRHQISSALVLPLQLYVLPCSGDNKPFLCWGRGYCFTEYCGFYVYTIELELGDA

SEQ ID NO: 539 - protein, 73 aa, Artificial sequence
  RRM domain
KLYISNLDYGVMNEDIKELFAEVGELKRYTVHFDRSGRSKGTAEVVYSRRGDALAAVKKYNDVQLDGKPMKIE

SEQ ID NO: 540 - protein, 14 aa, Artificial sequence
  Motif 10 - N-term
SAEDLDADLDKYHS

SEQ ID NO: 541 - protein, 15 aa, Artificial sequence
  Motif 11 - C-term
LDMSLDDMIAKNRKS

SEQ ID NO: 542 - protein, 12 aa, Artificial sequence
  Motif 12
KAPESTWGHDMF

SEQ ID NO: 543 - protein, 6 aa, Artificial sequence
  Motif 13
WQHDMY

SEQ ID NO: 544 - protein, 11 aa, Artificial sequence
  Motif 14
KLYISNLDYGV

SEQ ID NO: 545 - DNA, 56 bp, Artificial sequence
  primer 7
ggggacaagtttgtacaaaaaagcaggcttaaacaatgtcgactggattagatatg

SEQ ID NO: 546 - DNA, 49 bp, Artificial sequence
  primer 8
ggggaccactttgtacaagaaagctgggtgtcacgttccttagtttgtc

SEQ ID NO: 547 - DNA, 2194 bp, Oryza sativa; identical to SEQ ID NO: 128

SEQ ID NO: 548 - DNA, 1130 bp, Oryza sativa
catgcggctaatgtagatgctcactgcgctagtagtaaggtactccagtacattatggaatatacaaagctgtaatactcgtatcagcaagagagaggcacacaagttgtagcagtagcacaggattagaaaaacgggacgacaaatagtaatggaaaaacaaaaaaaaacaaggaaacacatggcaatataaatggagaaatcacaagaggaacagaatccgggcaatacgctgcgaaagtactcgtacgtaaaaaaaagaggcgcattcatgtgtggacagcgtgcagcagaagcagggatttgaaaccactcaaatccaccactgcaaaccttcaaacgaggccatggtttgaagcatagaaagcacaggtaagaagcacaacgccctcgctctccaccctcccacccaatcgcgacgcacctcgcggatcggtgacgtggcctcgccccccaaaaatatcccgcggcgtgaagctgacaccccgggcccacccacctgtcacgttggcacatgttggttatggttcccggccgcaccaaaatatcaacgcggcgcggcccaaaatttccaaaatcccgcccaagcccctggcgcgtgccgctcttccacccaggtccctctcgtaatccataatggcgtgtgtaccctcggctggttgtacgtgggcgggttaccctgggggtgtgggtggatgacgggtgggcccggaggaggtccggccccgcgcgtcatcgcggggcggggtgtagcgggtgcgaaaaggaggcgatcggtacgaaaattcaaattaggaggtggggggcggggcccttggagaataagcggaatcgcagatatgcccctgacttggcttggctcctcttcttcttatcccttgtcctcgcaaccccgcttccttctctcctctcctcttctcttctcttctctggtggtgtgggtgtgtccctgtctcccctctccttcctcctctcctttcccctcctctcttcccccctctcacaagagagagagcgccagactctccccaggtgaggtgagaccagtctttttgctcgattcgacgcgcctttcacgccgcctcgcgcggatctgaccgcttccctcggccttctcgcaggattcagcc

The invention claimed is:

1. A method for enhancing yield-related traits in a plant relative to a control plant, comprising introducing and expressing in a plant a nucleic acid encoding a Terminal Flower 1-like (TFL1-like) polypeptide and selecting for a plant having enhanced yield-related traits, where the yield-related traits are selected from the group consisting of increased total seed weight, increased number of filled seeds per panicle, increased number of filled seeds, increased seed fill rate, increased number of flowers per panicle, increased harvest index, increased thousand kernel weight (TKW), and increased plant height, and wherein said nucleic acid is selected from the group consisting of:
   (a) a nucleic acid comprising the nucleotide sequence of SEQ ID NO: 1;
   (b) a nucleic acid encoding a polypeptide comprising the amino acid sequence of SEQ ID NO: 2; and
   (c) a nucleic acid encoding a polypeptide comprising an amino acid sequence having at least 95% sequence identity to the amino acid sequence of SEQ ID NO: 2.

2. The method of claim 1, wherein said TFL1-like polypeptide comprises an amino acid sequence having at least 95% sequence identity to the amino acid sequence of SEQ ID NO: 2 and comprises:
   (i) a phosphatidylethanolamine-binding protein (PEBP) domain comprising amino acids 66-88 of SEQ ID NO: 2, and
   (ii) a conserved histidine or tyrosine residue at a location equivalent to that of amino acid residue His86 (H86) in SEQ ID NO: 2 and a conserved aspartic acid or glutamic acid residue at a location equivalent to that of amino acid residue Asp142 (D142) in SEQ ID NO: 2.

3. The method of claim 1 wherein said enhanced yield-related trait is selected from the group consisting of increased total seed weight, increased number of filled seeds, and increased number of filled seeds per panicle.

4. The method of claim 1, wherein said enhanced yield-related traits are obtained under non-stress conditions or under drought stress growth conditions.

5. The method of claim 1, wherein said nucleic acid is operably linked to a constitutive promoter, a GOS2 promoter, or a GOS2 promoter from rice.

6. The method of claim 1, wherein said nucleic acid encoding a TFL1-like polypeptide is of plant origin.

7. The method of claim 1, wherein said TFL1-like polypeptide comprises the amino acid sequence of SEQ ID NO: 2, or is encoded by a nucleic acid comprising the nucleotide sequence of SEQ ID NO: 1.

8. A plant or part thereof, including seeds, obtained by the method of claim 1, wherein said plant or part thereof comprises a recombinant nucleic acid encoding said TFL1-like polypeptide, wherein the recombinant nucleic acid is operably linked to a GOS2 promoter.

9. The plant of claim 8, or a transgenic plant cell derived thereof, wherein said plant is a crop plant, a monocot, or a cereal.

10. Harvestable parts of the plant of claim 9, wherein said harvestable parts comprise said recombinant nucleic acid.

11. Products derived from the plant of claim 9 and/or from harvestable parts of the plant of claim 9, wherein said products comprise said recombinant nucleic acid.

12. A method of making a plant having increased seed yield relative to a control plant comprising:
   (i) transforming a plant with a construct, wherein the construct comprises:
      (1) a nucleic acid encoding a TFL1-like polypeptide selected from the group consisting of:
         (a) a nucleic acid comprising the nucleotide sequence of SEQ ID NO: 1;
         (b) a nucleic acid encoding a polypeptide comprising the amino acid sequence of SEQ ID NO: 2; and
         (c) a nucleic acid encoding a polypeptide comprising an amino acid sequence having at least 95% sequence identity to the amino acid sequence of SEQ ID NO: 2;
      (2) one or more control sequences capable of driving expression of the nucleic acid of (1); and optionally
      (3) a transcription termination sequence, wherein one of the control sequences is a GOS2 promoter operably linked to the nucleic acid encoding a TFL1-like polypeptide; and
   (ii) selecting a plant having increased seed yield relative to a control plant.

13. The method of claim 12, wherein the nucleic acid encoding a TFL1-like polypeptide comprises the nucleotide sequence of SEQ ID NO: 1, or encodes a polypeptide comprising the amino acid sequence of SEQ ID NO: 2.

14. A method for the production of a transgenic plant having increased yield relative to a control plant, comprising:
   (i) introducing and expressing in a plant a nucleic acid encoding a TFL1-like polypeptide selected from the group consisting of:
      (a) a nucleic acid comprising the nucleotide sequence of SEQ ID NO: 1;
      (b) a nucleic acid encoding a polypeptide comprising the amino acid sequence of SEQ ID NO: 2; and
      (c) a nucleic acid encoding a polypeptide comprising an amino acid sequence having at least 95% sequence identity to the amino acid sequence of SEQ ID NO: 2;
   (ii) cultivating the plant under conditions promoting plant growth and development; and
   (iii) selecting for a plant having increased yield relative to a control plant, wherein the increased yield comprises increased total seed weight, increased number of filled seeds per panicle, increased number of filled seeds, increased seed fill rate, increased number of flowers per panicle, increased harvest index, increased thousand kernel weight (TKW), and/or increased plant height.

15. The method of claim 14, wherein the nucleic acid encoding a TFL1-like polypeptide comprises the nucleotide sequence of SEQ ID NO: 1, or encodes a polypeptide comprising the amino acid sequence of SEQ ID NO: 2.

16. The method of claim 14, wherein the enhanced yield-related traits are obtained under non-stress conditions.

* * * * *